United States Patent
Minshull et al.

(10) Patent No.: US 11,162,102 B2
(45) Date of Patent: Nov. 2, 2021

(54) MODIFICATIONS OF MAMMALIAN CELLS USING ARTIFICIAL MICRO-RNA TO ALTER THEIR PROPERTIES AND THE COMPOSITIONS OF THEIR PRODUCTS

(71) Applicant: DNA TWOPOINTO INC., Newark, CA (US)

(72) Inventors: Jeremy Minshull, Los Altos, CA (US); Maggie Lee, San Jose, CA (US); Varsha Sitaraman, San Mateo, CA (US); Ferenc Boldog, Fremont, CA (US)

(73) Assignee: DNA TWOPOINTO INC., Newark, CA (US)

( * ) Notice: Subject to any disclaimer, the term of this patent is extended or adjusted under 35 U.S.C. 154(b) by 0 days.

(21) Appl. No.: 16/872,051

(22) Filed: May 11, 2020

(65) Prior Publication Data

US 2020/0362344 A1    Nov. 19, 2020

Related U.S. Application Data

(60) Provisional application No. 62/846,847, filed on May 13, 2019, provisional application No. 62/870,321, filed on Jul. 3, 2019, provisional application No. 62/981,417, filed on Feb. 25, 2020, provisional application No. 63/019,733, filed on May 4, 2020.

(51) Int. Cl.
| | |
|---|---|
| *C12N 15/113* | (2010.01) |
| *C12N 15/90* | (2006.01) |
| *C12N 15/86* | (2006.01) |
| *C12N 9/12* | (2006.01) |

(52) U.S. Cl.
CPC .......... *C12N 15/113* (2013.01); *C12N 9/1241* (2013.01); *C12N 15/86* (2013.01); *C12N 15/90* (2013.01); *C12N 2310/141* (2013.01); *C12N 2310/531* (2013.01); *C12N 2800/90* (2013.01); *C12Y 603/01002* (2013.01)

(58) Field of Classification Search
CPC .. C12N 15/113; C12N 15/90; C12N 2800/90; C12N 2310/531; C12N 2310/141; C12N 15/1137; C12Y 603/01002
See application file for complete search history.

(56) References Cited

U.S. PATENT DOCUMENTS

| | | | | |
|---|---|---|---|---|
| 2012/0142764 | A1* | 6/2012 | Seol | C12N 15/111 514/44 R |
| 2012/0276063 | A1* | 11/2012 | Meyer | A61K 35/12 424/93.7 |
| 2013/0160152 | A1* | 6/2013 | Ostertag | A01K 67/0275 800/13 |
| 2013/0164851 | A1* | 6/2013 | Rossomando | C12N 15/1138 435/465 |
| 2013/0219565 | A1 | 8/2013 | Damude et al. | |
| 2014/0271926 | A1* | 9/2014 | Nguyen | A61K 38/08 424/667 |
| 2015/0011611 | A1 | 1/2015 | Kim et al. | |
| 2017/0101629 | A1* | 4/2017 | Minshull | C12N 9/1241 |

OTHER PUBLICATIONS

Chung et al (Nucl. Acids Res. 34(7): e53, 2006) (Year: 2006).*
Hu et al (Int. J. Mol. Sci. 2009, 10, 2158-2168) (Year: 2009).*
Shibata et al (J. RNAi and Gene Silencing 3(1): 237-247, 2007) (Year: 2007).*
PCT/US2020/032381 International Search Report and Written Opinion dated Oct. 6, 2020.
PCT/US2020/032381 Invitation to Pay Additional Fees dated Aug. 4, 2020.
Choi, et al., "Multiplexing Seven miRNA-Based shRNAs to Suppress HIV Replication," Molecular Therapy, vol. 23, No. 2, (Feb. 2015).
Santiago, et al., "Targeted gene knockout in mammalian cells by using engineered zinc-finger nucleases," PNAS, vol. 105, No. 15, 5809-5814, (Apr. 2008).
Sun, et al., "Multi-miRNA hairpin method that improves gene knockdown efficiency and provides linked multi-gene knockdown," BioTechniques, 41:59-63, (Jul. 2006).
Anastasov, et al., "Efficient shRNA delivery into B and T lymphoma cells using lentiviral vector-mediated transfer," J. Hematopathol, 2:9-19, (2009).
Snyder, et al., "RNA polymerase III can drive polycistronic expression of functional interfering RNAs designed to resemble microRNAs," Nucleic Acids Research, vol. 37, No. 19, e127, (2009).
Hu, et al., "Construction of an Artificial MicroRNA Expression Vector for Simultaneous Inhibition of Multiple Genes in Mammalian Cells," Int. J. Mol. Sci., 10, 2158-2168, (2009).
Wu, et al., "Improved siRNA/shRNA Functionality by Mismatched Duplex," PLoS One, vol. 6, Issue 12, e28580, (Dec. 2011).
Yu, et al., "Glutamine synthetase gene knockout-human embryonic kidney 293E cells for Stable production of monoclonal antibodies," Biotechnology and Bioengineering, vol. 115, Issue 5, p. 1367-1372, (Jan. 2018) abstract only.
Fan, et al, "Improving the efficiency of CHO cell line generation using glutamine synthetase gene knockout cells," Biotechnol Bioeng. 109(4): 1007-15, (Apr. 2012) abstract only.
Myburgh, et al., "Optimization of Critical Hairpin Features Allows miRNA-based Gene Knockdown Upon Single-copy Transduction," Molecular Therapy—Nucleic Acids, 3, e207, (2014).

* cited by examiner

*Primary Examiner* — Richard A Schnizer
(74) *Attorney, Agent, or Firm* — Alston & Bird LLP

(57) ABSTRACT

The present invention provides methods and compositions for stable genetic modification of cultured mammalian cells. The genetic modifications can be used to produce cultured mammalian cells for therapeutic or diagnostic purposes.

Figure 1B:
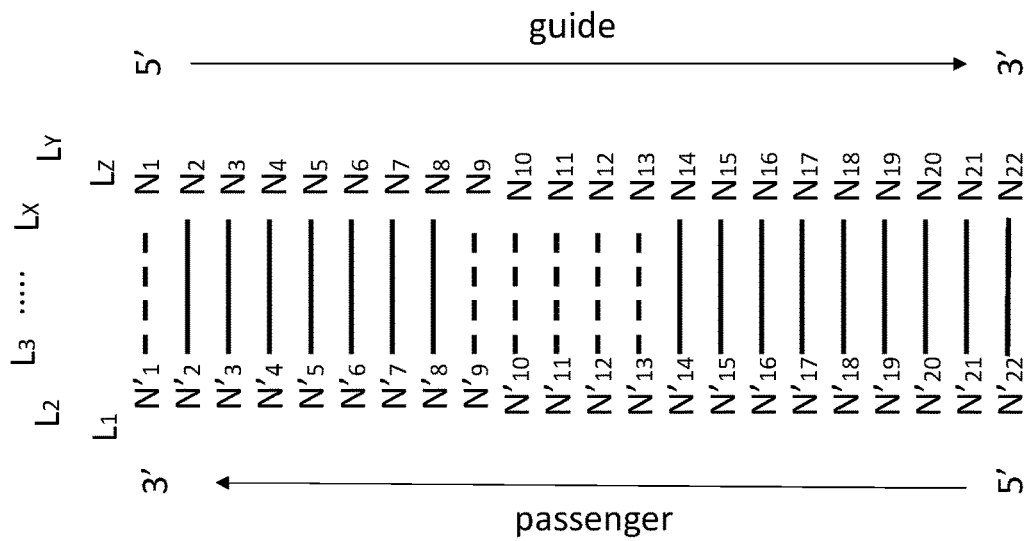

24 Claims, 9 Drawing Sheets
Specification includes a Sequence Listing.

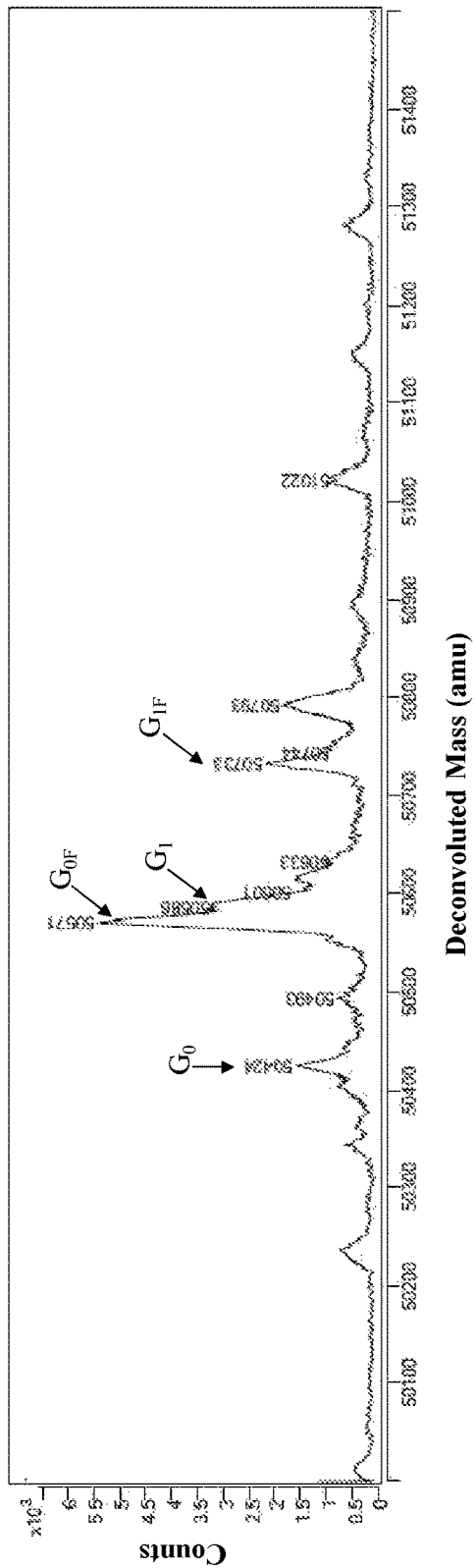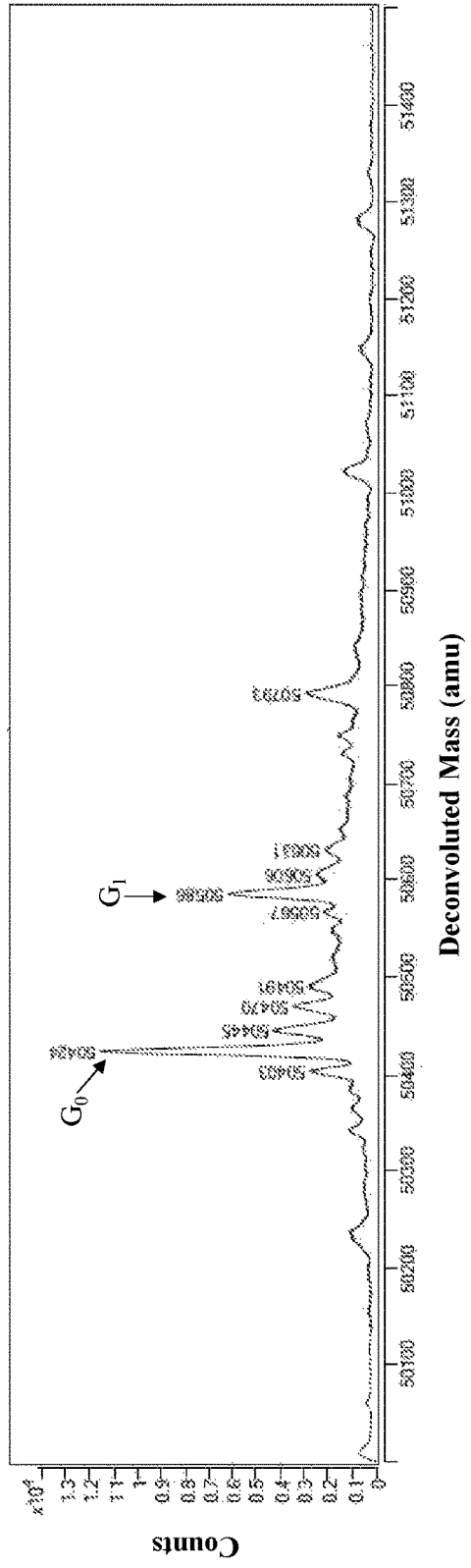

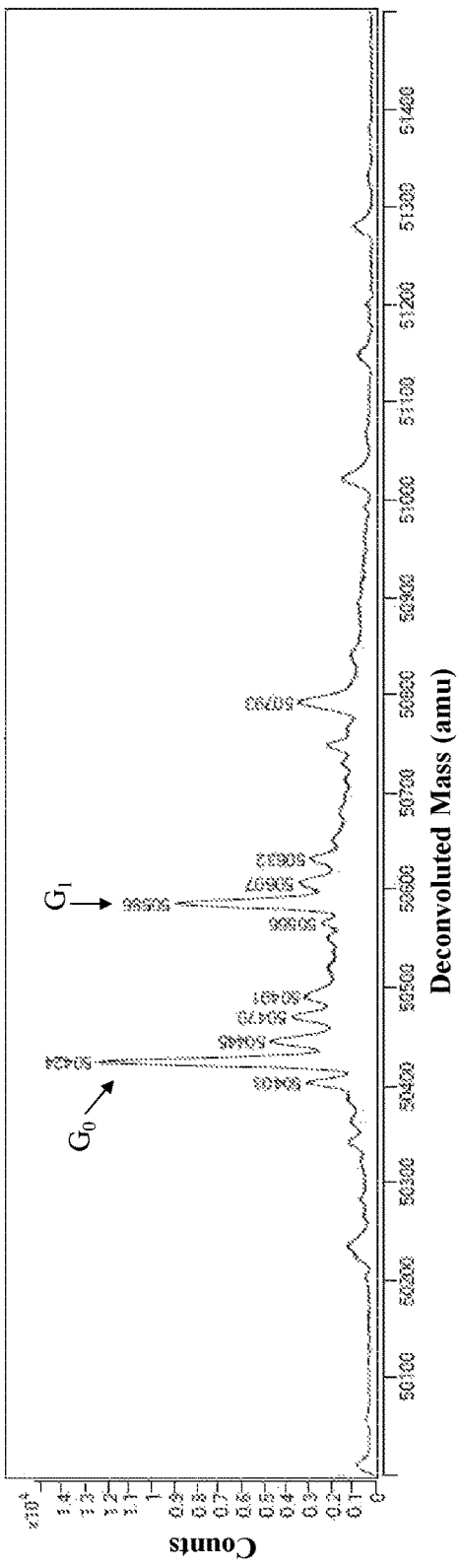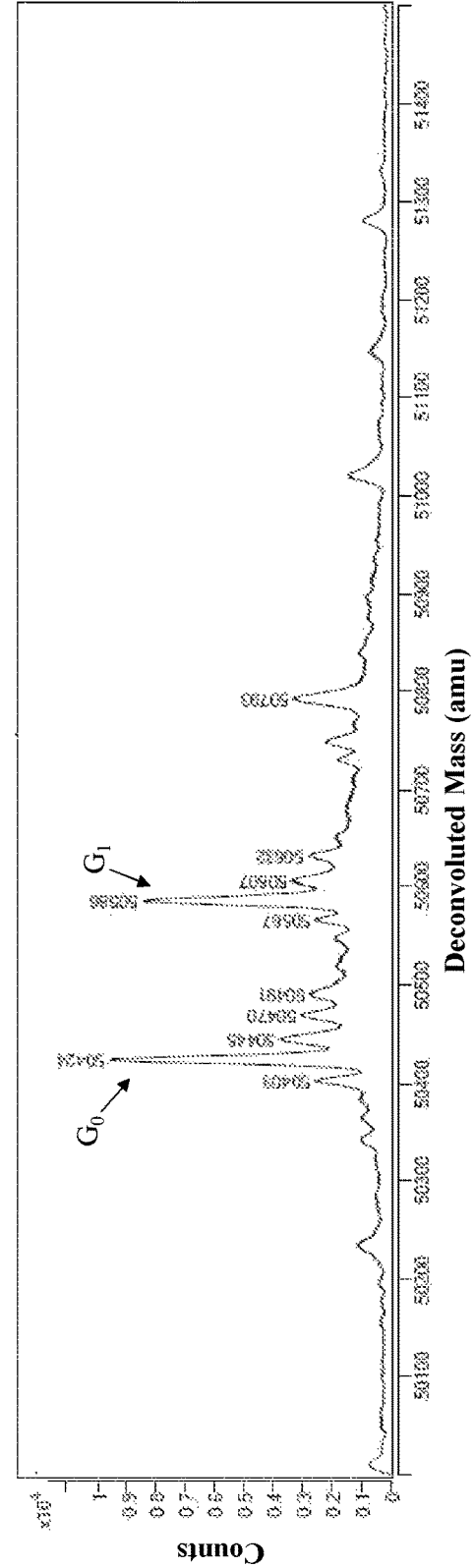

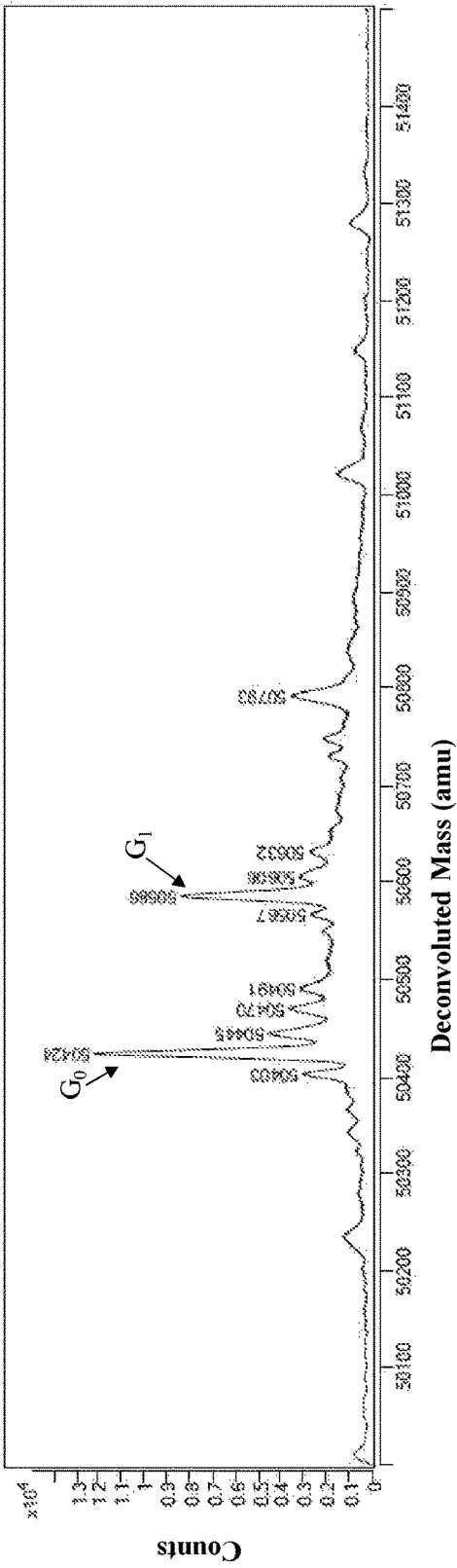
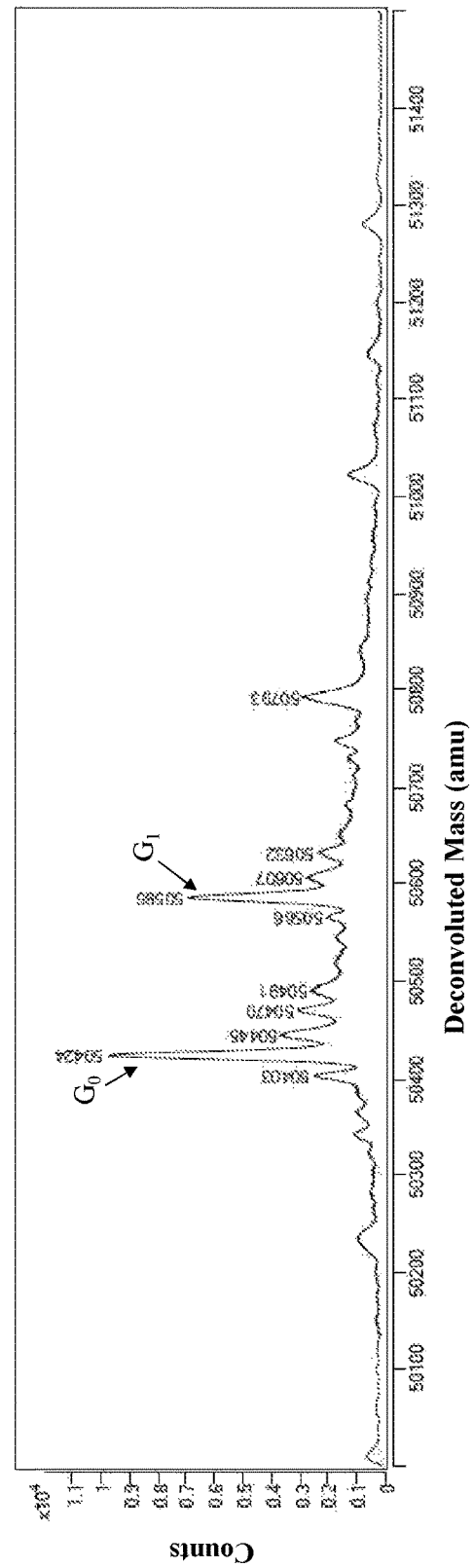

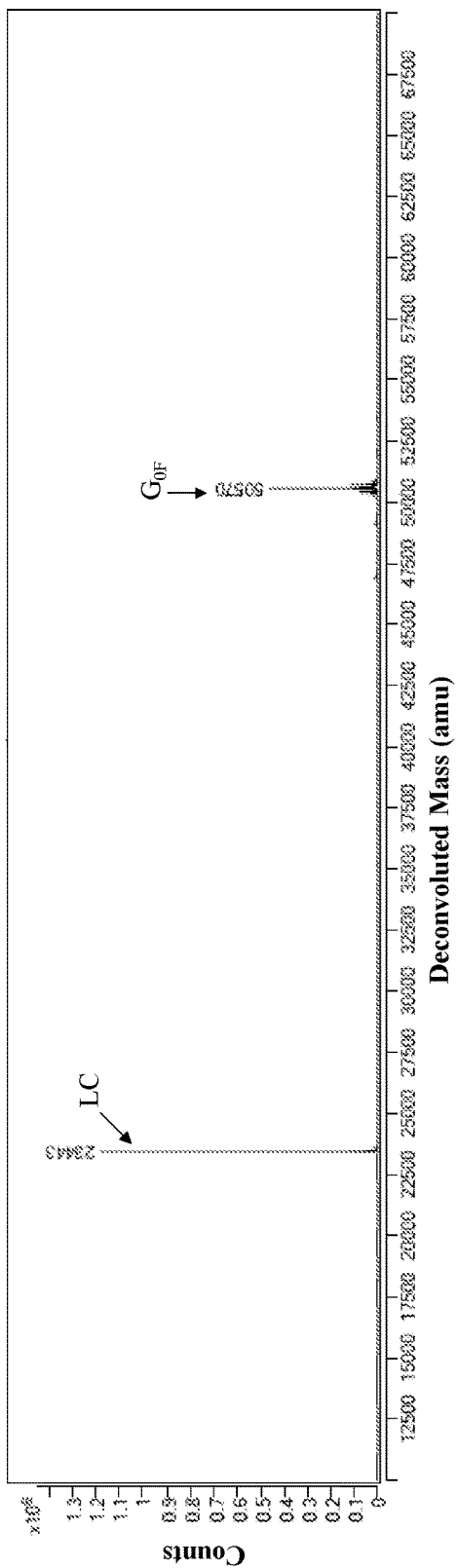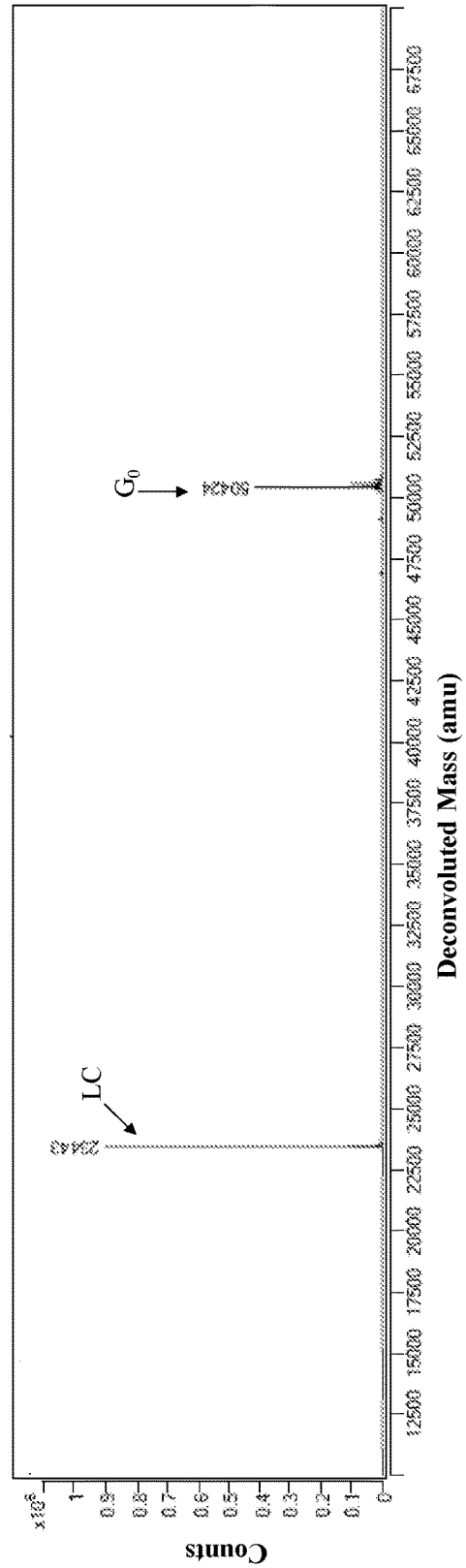

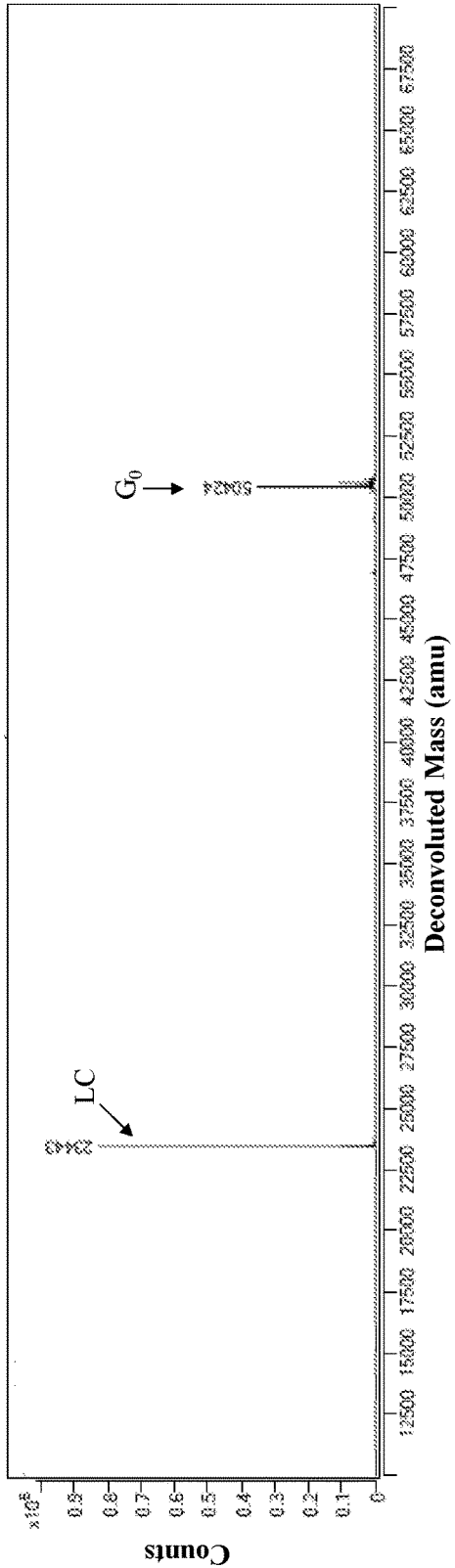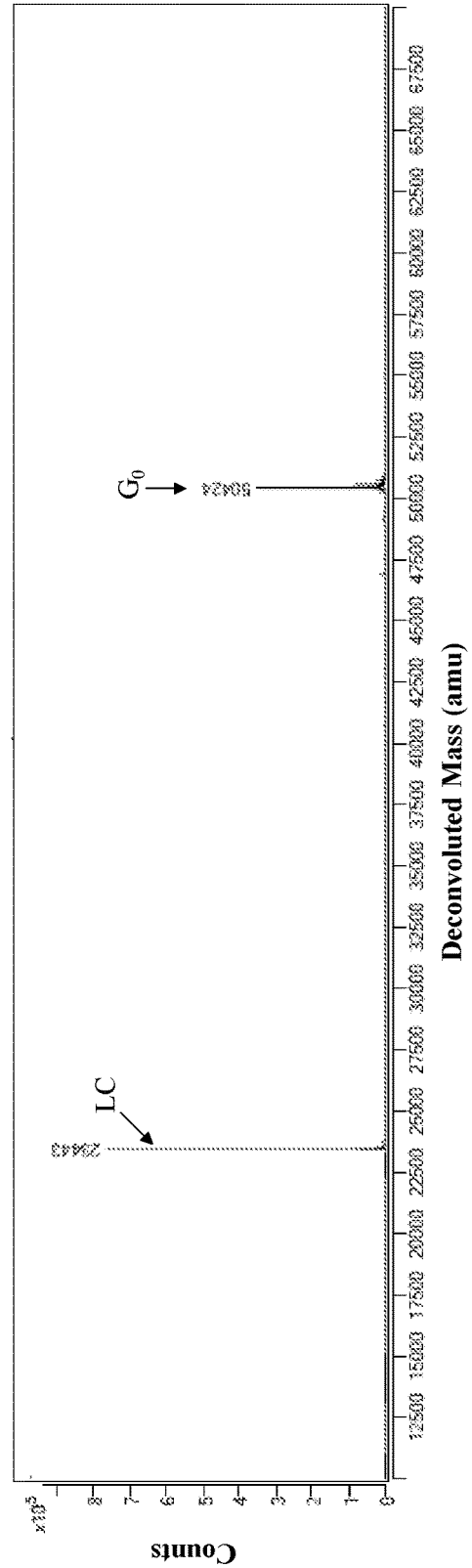

MODIFICATIONS OF MAMMALIAN CELLS USING ARTIFICIAL MICRO-RNA TO ALTER THEIR PROPERTIES AND THE COMPOSITIONS OF THEIR PRODUCTS

CROSS REFERENCE TO RELATED APPLICATIONS

The present application claims the benefit of 62/846,847, filed May 13, 2019, 62/870,321, filed Jul. 3, 2019, 62/981,417 filed Feb. 25, 2020 and 63/019,733 filed May 4, 2020, incorporated by reference in their entirety for all purposes.

REFERENCE TO A SEQUENCE LISTING

The application refers to sequences disclosed in a txt file named 548133SEQLST.TXT, of 1,094,956 bytes, created May 7, 2020, incorporated by reference.

2. BACKGROUND OF THE INVENTION

Introduction of heterologous nucleic acids into mammalian cells can be used to modify their properties, and the properties of molecules that they produce. Genetically modifiable properties of cultured mammalian cells include the glycosylation of proteins secreted by the cultured mammalian cell, proteolytic processing of proteins produced by the cultured mammalian call, intracellular trafficking of proteins produced by the cell, growth properties of the cell including which nutrients must be provided to the cell exogenously, and viability and susceptibility of the cells to apoptosis under various stresses including expression of high levels of heterologous proteins. Genetically modifiable properties of immune cells include the molecules that are recognized by the immune cell, cellular responses within the immune cell, the ability of the immune cell to survive and perform immune functions under certain environmental conditions including conditions that normally result in cell death, anergy or exhaustion, and the proteins produced by the immune cell.

Stable genetic modifications of mammalian cells can be made by integrating a heterologous polynucleotide into the genome of the cultured mammalian cell. Heterologous DNA may be introduced into cells in different ways: by transfecting with naked plasmid DNA, by packaging the DNA into viral particles used to infect the cultured mammalian cells, or by transfecting cells with a transposon and its corresponding transposase.

Non-viral vector systems, including plasmid DNA, often suffer from inefficient cellular delivery, cellular toxicity and limited duration of transgene expression due to the lack of genomic insertion and resulting degradation and/or dilution of the vector in transfected cell populations. Transgenes delivered by non-viral approaches often form long, repeated arrays (concatemers) that are targets for transcriptional silencing by heterochromatin formation.

Viral packaging generally imposes limits on the size of the DNA that can be inserted. There are also safety concerns regarding viral integration sites, and the costs and complexities of viral manufacture.

The expression levels of genes encoded on a polynucleotide integrated into the genome of a cell depend on the configuration of sequence elements within the polynucleotide. The efficiency of integration and thus the number of copies of the polynucleotide that are integrated into each genome, and the genomic loci where integration occurs also influence the expression levels of genes encoded on the polynucleotide. The efficiency with which a polynucleotide may be integrated into the genome of a target cell can often be increased by placing the polynucleotide into a transposon. Transposons comprise two ends that are recognized by a transposase. The transposase acts on the transposon to excise it from one DNA molecule and integrate it into another. The DNA between the two transposon ends is transposed by the transposase along with the transposon ends. Heterologous DNA flanked by a pair of transposon ends, such that it is recognized and transposed by a transposase is referred to herein as a synthetic transposon. Introduction of a synthetic transposon and a corresponding transposase into the nucleus of a eukaryotic cell may result in transposition of the transposon into the genome of the cell. Transposon/transposase gene delivery platforms have the potential to overcome the limitations of naked DNA and viral delivery. The piggyBac-like transposons are attractive because of their unlimited gene cargo capacity, but Mariner transposons such as Sleeping Beauty, or hAT transposons such as TcBuster also provide efficient methods for integrating heterologous DNA into mammalian cell genomes.

The properties of mammalian cells can be favorably modified by inhibiting genes endogenous to the mammalian cells. RNA interference methods may be used to inhibit endogenous mammalian cell genes in order to favorably modify the properties of the mammalian cells. RNA interference is a promising technology for inhibiting endogenous genes of mammalian cells. The techniques currently being used suffer from limitations that prevent reliable long-term inhibition of gene expression. One widely used technique is to treat immune cells with siRNA, either by transfection of the siRNA or by treatment with chemically modified siRNA. This is useful as an experimental technique to determine phenotypic effects of gene knock-down or gene knock-out. RNA is labile, however, so any effects of siRNA administered as RNA are transient. A second technique is to transfect in genes encoding shRNAs which are operably linked to a promoter transcribed by RNA polymerase III. This technique is frequently limited by the variable efficacy of individual shRNA molecules, as well as the highly variable rate of random integration. The variable rate of random integration can be solved using lentiviral vectors, but the variability of shRNA efficacy is still highly problematic (Anastasov et. al., 2009. J. Hematop 2, 9-19. "Efficient shRNA delivery into B and T lymphoma cells using lentiviral vector-mediated transfer").

MicroRNAs (miRNAs) are naturally occurring RNAs that are transcribed from their genes by RNA polymerase II. MicroRNAs comprise intramolecular double-stranded RNA hairpins, which are processed by cellular enzymes to produce a "guide strand" that is complementary to one or more mRNA targets. The guide strand is physically associated with the RISC complex, and acts through the RISC complex to inhibit expression of the target mRNA. Artificial miRNAs (amiRNAs) can be designed by using a natural scaffold and adapting it to produce guide strands that inhibit targets other than the natural target. Artificial miRNAs can also be transcribed by RNA polymerase III (Snyder et. al., 2009. Nucl. Acis. Res 37 e127 doi:10.1093/nar/gkp657. "RNA polymerase III can drive polycistronic expression of functional interfering RNAs designed to resemble microRNAs"). The use of miRNA scaffolds can improve the processing of interfering RNAs, but variability in effectiveness remains a challenge. There is thus a need in the art for a robust RNA interference method for the inhibition of genes endogenous to mammalian cells in order to modify the properties of mammalian cells, or of the proteins or other compounds that mammalian cells produce.

Disclosed herein are methods and compositions for introducing into mammalian cells polynucleotides comprising artificial microRNAs to inhibit genes endogenous to the mammalian cells, in order to effect advantageous phenotypic changes.

3. SUMMARY OF THE INVENTION

Methods for modifying the genomes of mammalian cells in order to inhibit expression of endogenous genes are described. Mammalian cells may include mammalian cells cultured for the production of expressed proteins. They may also include immune cells including lymphocytes such as T-cells and B-cells and natural killer cells (NK cells), T-helper cells, antigen-presenting cells, dendritic cells, neutrophils and macrophages.

RNA interference methods may be used to inhibit expression of endogenous mammalian cell genes in order to favorably modify the properties of the mammalian cells. Here we describe methods for improving the efficiency of RNA interference: (i) the gene expressing the interfering RNA (for example the shRNA or amiRNA gene) may be incorporated into a transposon, wherein one or more copies of the transposon are integrated into transcriptionally active regions of the mammalian cell genome, and (ii) the interfering RNA comprises two or more different guide strands that are complementary to two or more different sequences within the same mRNA target. Providing two or more guide strands complementary to different sequences within the same mRNA target, either in a lentiviral vector or a transposon vector substantially improves the reliability of RNA interference.

Methods for designing polynucleotides for the inhibition of genes expressed in mammalian cells are described. A preferred gene transfer polynucleotide for the inhibition of a target gene (the "inhibitory gene transfer polynucleotide") comprises two or more different hairpin sequences that can be expressed in the target mammalian cell to produce two or more different RNA guide strand sequences, each of which is complementary to a different region of the target mRNA. The first (guide) sequence comprises between 19 and 22 contiguous bases that are complementary to the target mRNA and the second (guide) sequence comprises between 19 and 22 contiguous bases that are complementary to the target mRNA. The first and second guide strand sequences are different from each other but complementary to the same target mRNA. Optionally the gene transfer polynucleotide comprises a third hairpin sequence expressible in the target mammalian cell to produce an RNA guide strand sequence comprising between 19 and 22 contiguous bases that are complementary to the target mRNA and the first, second and third guide strand sequences are different from each other. Each hairpin sequence in the inhibitory gene transfer polynucleotide comprises a guide strand sequence and a complementary passenger strand sequence. Each guide strand sequence is separated from its corresponding passenger strand sequence by a sequence that, in the expressed RNA, forms an unpaired loop of between 5 and 35 bases. Each passenger strand sequence comprises at least 19 bases that are at least 78% identical to the reverse complement of its corresponding guide strand sequence (i.e. within those 19 bases it comprises no more than 4 mismatches, including mutations, single base deletions or single base insertions, relative to the identical reverse complement of the corresponding guide strand sequence). The differences between the guide and passenger strand sequences are selected to favor processing of the transcribed hairpins by the mammalian RNA interference pathway and loading of the guide strand(s) into the RISC complex, to reduce expression of the target mRNA. Hairpin sequences of the invention (that is the combination of guide, loop and passenger strand sequences) in the gene transfer polynucleotide are preferably sequences that are not naturally expressed sequences in mammalian cells, or from viruses that may infect mammalian cells. Hairpin sequences of the invention are preferably expressed from one or more artificial micro-RNAs.

The inhibitory gene transfer polynucleotide comprises two or more hairpin sequences that are each operably linked to a heterologous promoter active in the target mammalian cell. Each hairpin sequence may be operably linked to the same promoter, or they may be linked to separate promoters. Preferably the promoter is transcribed by RNA polymerase II or RNA polymerase III, more preferably the promoter is transcribed by RNA polymerase II. In some embodiments, the promoter is an inducible promoter.

In some embodiments the inhibitory gene transfer polynucleotide comprises (a) a segment encoding a multi-hairpin amiRNA sequence, wherein the segment comprises (i) a first guide strand sequence comprising a contiguous 19-22 nucleotide sequence that is perfectly complementary to a first target site of a natural mammalian cellular mRNA and a first passenger strand sequence comprising a contiguous 19-22 nucleotide sequence that is at least 78% complementary to the first guide strand sequence, wherein the first guide strand and first passenger strand sequence are separated by between 5 and 35 nucleotides; (ii) a second guide strand sequence comprising a contiguous 19-22 nucleotide sequence that is perfectly complementary to a second target site different than the first target site of the same natural mammalian cellular mRNA as the first guide strand sequence and a second passenger strand sequence comprising a contiguous 19-22 nucleotide sequence that is at least 78% complementary to the second guide strand sequence, wherein the second guide strand and second passenger strand sequence are separated by between 5 and 35 nucleotides, and wherein the first and second guide strand sequence are different from each other; and (b) a eukaryotic promoter that is active in a mammalian cell and is transcribed by RNA polymerase II or RNA polymerase III and that is operably linked to the segment encoding the amiRNA sequence, wherein the amiRNA sequence can be expressed and fold into multiple hairpins. The first passenger strand sequence may be the same length as the first guide strand sequence, or it may be shorter by 1-3 nucleotides. The first and second target sites in the mammalian cellular mRNA may have some overlap not overlap.

Advantageous inhibitory gene transfer polynucleotides are stably maintained in the mammalian cell, so that the target gene is permanently repressed. Preferably the inhibitory gene transfer polynucleotide is integrated into the genome of the mammalian cell. To facilitate stable integration of the inhibitory gene transfer polynucleotide into the genome of the mammalian cell it is advantageous to incorporate the hairpin sequences and regulatory elements required for their expression into a transposon such as a piggyBac-like transposon, or a Mariner transposons such as a Sleeping Beauty transposon, or an hAT transposon such as a TcBuster transposon, or into a viral vector such as a lentiviral vector. An advantageous inhibitory gene transfer polynucleotide comprises two or more different hairpin sequences expressible in a mammalian cell, each hairpin sequence comprising a different sequence of at least 19 or 20 or 21 or 22 contiguous bases that are complementary to the target mRNA, wherein each hairpin is operably linked to a promoter that is active in a mammalian cell, and wherein the hairpins and their operably linked promoters are flanked by the inverted terminal repeats of a piggyBac-like transposon, or the inverted terminal repeats of a Mariner transposon such as a Sleeping Beauty transposon, or the inverted terminal repeats of an hAT transposon such as a TcBuster transposon such that the hairpins and their operably linked promoters are transposable by a corresponding transposase. Alternatively the hairpins and their operably linked promoters are flanked by the inverted terminal repeats of a lentivirus so that they can be packaged into a viral particle.

A method of the invention comprises introducing into a mammalian cell an inhibitory gene transfer polynucleotide comprising two or more different hairpin sequences expressible in the mammalian cell to produce two or more different guide RNA sequences, each of which is complementary to a different region of the same target mRNA. For an inhibitory gene transfer polynucleotide wherein the hairpin sequences are carried on a transposon vector, the method may further comprise introducing into the mammalian cell a corresponding transposase, either as protein or as a nucleic acid encoding the transposase. For an inhibitory gene transfer polynucleotide wherein the hairpin sequences are carried on a viral vector, the method may further comprise packaging the polynucleotide into viral particles and contacting the mammalian cell with the viral particles.

Optionally the inhibitory gene transfer polynucleotide also comprises a gene encoding a protein expressible in the mammalian target cell, wherein the protein modifies the properties, behavior or products of the mammalian cell. For example, the gene transfer polynucleotide may comprise an open reading frame encoding a chimeric antigen receptor, a T-cell receptor, an antibody, a bispecific antibody, a receptor or any kind of therapeutic protein, operably linked to regulatory elements that make the protein expressible in the target mammalian cell. In this way a single polynucleotide may carry sequences that produce one or more heterologous protein within a mammalian cell, together with sequences transcribed to produce interfering RNA molecules that reduce the expression of one or more endogenous genes, such as those genes that may normally reduce the efficacy or survival of the mammalian cell in certain environments or under certain conditions. Optionally the gene encoding the protein that modifies the properties of the mammalian cell is operably linked to the same promoter as one or more of the hairpin sequences.

Human cell lines such as those from human embryonic kidney (HEK) and rodent cell lines such as those from the Chinese hamster ovary (CHO) are commonly used to produce therapeutic proteins including antibodies. These cells have an intrinsic fucosyl transferase activity. Antibody-dependent cellular cytotoxicity (ADCC) is greatly reduced by the core fucose of oligosaccharides attached to the Fc, which can reduce the clinical efficacy and anticancer activity of anti-tumor antibodies in humans in vivo. It is therefore advantageous to reduce or eliminate the fucosylation of proteins produced in mammalian culture cell lines, so that they will produce antibodies with higher ADCC activity. We disclose methods for designing polynucleotides comprising amiRNA sequences for reducing fucosylation of heterologously produced proteins, including antibodies, when produced in mammalian cells. Sequences of amiRNA-containing polynucleotides that can be used to reduce the level of fucosylation of heterologously produced proteins are also disclosed.

For rodent and human cell lines used in production of proteins that are normally targeted to lysozomes, a substantial amount of the synthesized protein may be directed to the lysozome and subsequently degraded. This can result in decreased protein yields, as well as compromised cell viability. It is therefore advantageous to disrupt the pathway that normally traffics these proteins to the lysosome of the producing cell, such as the mannose-6-phosphate receptor, lysosomal integral membrane protein LIMP-2 and sortilin. We disclose methods for designing polynucleotides comprising amiRNA sequences for reducing lysosomal trafficking in mammalian cells, and sequences of amiRNA-containing polynucleotides that can be used to reduce a cell's lysosomal trafficking.

Development of human and rodent cell lines used for the manufacture of proteins often involves introduction of heterologous DNA encoding the proteins to be produced. The heterologous DNA frequently comprises a gene encoding a selectable marker to allow cells that have taken up the heterologous DNA to be identified/selected. One class of selectable marker that is particularly useful is one that allows the cell to survive and grow in the absence of an added nutrient. For such a selection to work, the cell must lack a functional endogenous copy of the selectable marker, so that it is dependent upon the added copy. Cultured mammalian cells have been modified by directed or non-directed deletion or mutation of their endogenous genes involved in amino acid and nucleotide synthesis, in particular the glutamine synthetase and dihydrofolate reductase genes. Deletions of genes in chromosomes are complex and time-consuming. An alternative is the use of RNA interference to permanently reduce expression of the endogenous glutamine synthetase or dihydrofolate reductase genes. We disclose methods for designing polynucleotides comprising amiRNA sequences for reducing expression of glutamine synthetase and dihydrofolate reductase in mammalian cells, and sequences of amiRNA-containing polynucleotides that can be used to accomplish such reduction.

For rodent and human cell lines used in production of proteins that are normally proteolytically cleaved, such cleavage can result in decreased protein yields, or in heterogeneous protein product. It can therefore be advantageous to disrupt the proteases. We disclose methods for designing polynucleotides comprising amiRNA sequences for reducing proteolysis in mammalian cells, and sequences of amiRNA-containing polynucleotides that can be used to reduce proteolysis.

For rodent and human cell lines used in production of proteins, high levels of protein expression can decrease cell viability. It can therefore be advantageous to disrupt genes involved in the normal apoptosis pathway. We disclose methods for designing polynucleotides comprising amiRNA sequences for reducing apoptosis in mammalian cells, and sequences of amiRNA-containing polynucleotides that can be used to reduce apoptosis.

The ability to enhance the function, persistence and proliferation of human T-cells is a current bottle neck for cancer immunotherapy. Technologies that allow improved performance, expansion and genetic manipulation of T-cells are in high demand. The ability to control and expand T-cells has a number of applications, including the following. (i) Improving the function of T-cell therapy for greater efficacy and or safety, for example in combination with CAR-T. (ii) Reversing T-cell exhaustion of tumor infiltrating T-cells. (iii)

Improving the survival of human T-cells in mice for preclinical study (in vivo). (iv) Identification of antigen-specific T-cells and cloning T-cell receptors in vitro. (v) Developing T-cell lines that can be maintained ex-vivo, and that still perform biological functions of T-cells (such as cell killing). Modifications that can be effected by the introduction of inhibitory gene transfer systems that function through RNA interference, such as inhibitory gene transfer systems comprising amiRNAs, include enhancing the ability of an immune cell to survive and/or proliferate under certain conditions or in certain environments, altering the amount or type of proteins expressed on the immune cell surface, preventing the immune cell from becoming inactivated by internal or external stimuli, and altering the response of the immune cell to proteins or small molecules that contact the cell. We disclose methods for designing polynucleotides comprising amiRNA sequences for modifying immune cell function, and sequences of amiRNA-containing polynucleotides that can be used to improve immune cell function.

Immune cell genes whose expression may be reduced by RNA interference from inhibitory gene transfer polynucleotides in order to improve the proliferation, survival or function of immune cells in hostile environments such as within a tumor include: thymocyte selection-associated high mobility group box proteins TOX and TOX1, T-cell immunoglobulin mucin receptor 3, nuclear factor of activated T-cells, programmed cell death protein 1, nuclear receptor 4A1 (Nur77), nuclear receptor 4A2 (Nurr1), nuclear receptor 4A3 (NOR1), Fas cell surface death receptor (tumor necrosis factor receptor superfamily member 6), cytotoxic T-lymphocyte-associated protein 4, caspase 3, caspase 7, caspase 8, caspase 9, caspase 10, death receptor 4 (tumor necrosis factor receptor superfamily member 10A), death receptor 5 (tumor necrosis factor receptor superfamily member 10B), cytotoxic T-lymphocyte protein 4 (CTLA-4), apoptosis regulator BAX and BAD (Bcl2-associated agonist of cell death).

A modified mammalian cell, including a modified human immune cell whose genome comprises an inhibitory gene transfer polynucleotide comprising two or more different hairpin sequences expressible in the mammalian cell to produce two or more different guide RNA sequences each of which is complementary to a different region of the target mRNA are an aspect of the invention. In addition, animal immune cells whose genome comprises an inhibitory gene transfer polynucleotide comprising two or more different hairpin sequences expressible in the mammalian cell to produce two or more different guide RNA sequences each of which is complementary to a different region of the target mRNA are also of value as experimental models and as animal therapeutic agents. A modified mammalian cell, including a modified human immune cell comprising an inhibitory gene transfer polynucleotide that has been integrated through the action of a piggyBac-like transposase comprises at least two hairpins, each hairpin comprising a different sequence of at least 19 or 20 or 21 or 22 contiguous bases that are complementary to the a different region of the same target mRNA, and each hairpin is operably linked to a promoter that is active in a mammalian immune cell, wherein the hairpins and the promoter are flanked by the inverted terminal repeats of a piggyBac-like transposon. A modified mammalian cell, including a modified human immune cell comprising an inhibitory gene transfer polynucleotide that has been integrated through the action of a Sleeping Beauty transposase comprises at least two hairpins, each hairpin comprising a different sequence of at least 19 or 20 or 21 or 22 contiguous bases that are complementary to the a different region of the same target mRNA, and each hairpin is operably linked to a promoter that is active in a mammalian immune cell, wherein the hairpins and the promoter are flanked by the inverted terminal repeats of a Sleeping Beauty transposon. A modified mammalian cell, including a modified human immune cell comprising an inhibitory gene transfer polynucleotide that has been integrated through the action of a TcBuster transposase comprises at least two hairpins, each hairpin comprising a different sequence of at least 19 or 20 or 21 or 22 contiguous bases that are complementary to a different region of the same target mRNA, and each hairpin is operably linked to a promoter that is active in a mammalian immune cell, wherein the hairpins and the promoter are flanked by the inverted terminal repeats of a TcBuster transposon. A modified mammalian cell, including a modified human immune cell comprising an inhibitory gene transfer polynucleotide that has been integrated through the action of a lentiviral system comprises at least two hairpins, each hairpin comprising a different sequence of at least 19 or 20 or 21 or 22 contiguous bases that are complementary to a different region of the same target mRNA, and each hairpin is operably linked to a promoter that is active in a mammalian immune cell, wherein the hairpins and the promoter are flanked by the inverted terminal repeats of a lentivirus. Preferably the immune cell whose genome comprises an inhibitory gene transfer polynucleotide has improved proliferation, survival or functional properties relative to an immune cell whose genome does not comprise such an inhibitory gene transfer polynucleotide.

Sequences of gene transfer polynucleotides for effecting genomic modifications of mammalian cells are provided.

4. BRIEF DESCRIPTION OF THE DRAWINGS

Figure 1A:
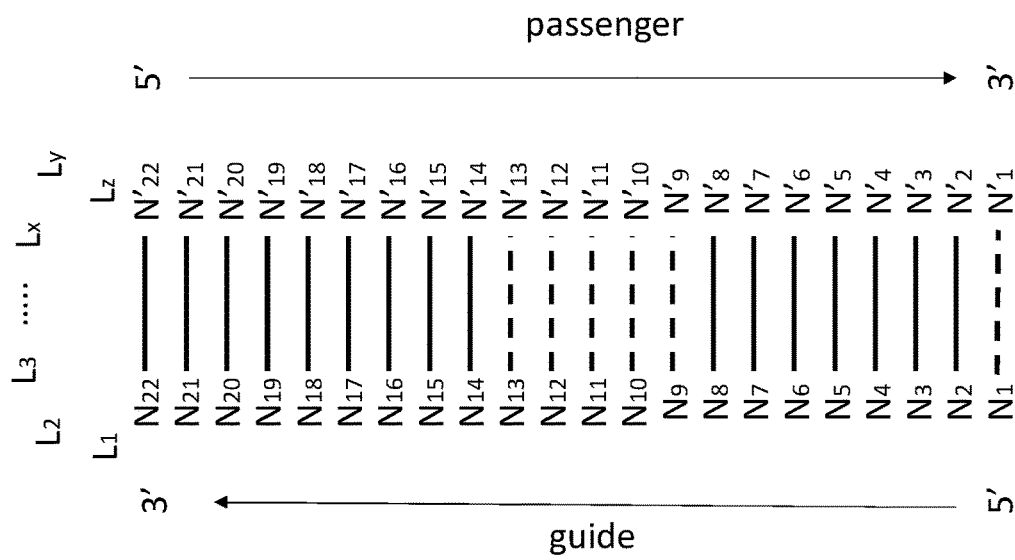

FIGS. 1A-B: Schematic representation of guide and passenger strand sequence organization. Nucleotides are shown for the coding strand of a single miRNA hairpin. The guide strand sequence is represented as 22 contiguous nucleotides $N_1$ to $N_{22}$. The sequence of the guide strand is preferably a perfect reverse complement of the target mRNA whose expression is to be reduced. The passenger strand sequence is represented as 22 contiguous nucleotides $N'_1$ to $N'_{22}$. The passenger strand sequence is preferably an imperfect reverse complement of the guide strand sequence. Corresponding bases in the guide strand sequence and passenger strand sequence are indicated by horizontal lines. For bases joined by a solid line, the base in the passenger strand is preferably the complementary base to the base in the guide strand. It is preferable if, for one or more of the bases joined by a dotted line, the base in the passenger strand is preferably not the complementary base to the base in the guide strand. If the base in the guide strand is an A or a T, the base in the passenger strand sequence is preferably a C. If the base in the guide strand sequence is a C or a G, the base in the passenger strand sequence is preferably an A. Most preferably the passenger strand sequence base at position $N'_1$ is not complementary to the guide strand sequence base $N_1$. Most preferably the passenger strand sequence base at position $N'_{12}$ is not complementary to the guide strand sequence base $N_{12}$. Mismatches may also be obtained if one or more base in the passenger strand are deleted. The guide strand sequence and the passenger strand sequence are joined by a 5-35 nucleotide unstructured loop sequence, represented as $L_1$-$L_Z$. The guide strand sequence may be to the 5' of the loop sequence as shown in FIG. 1A, or to the 3' of the loop sequence, as shown in FIG. 1B.

Figure 2A:
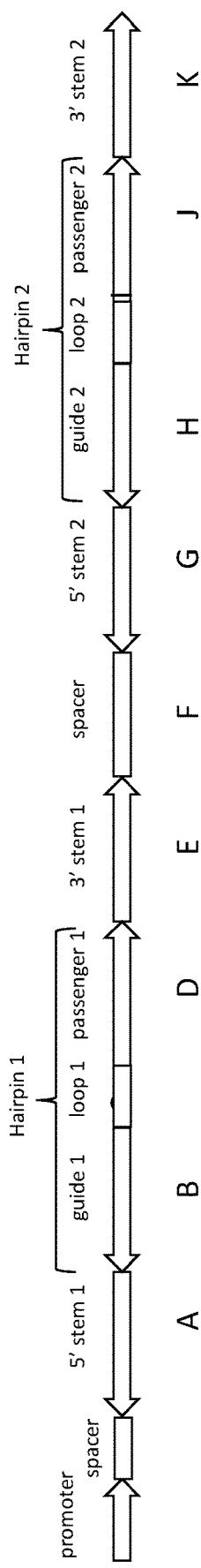
Figure 2B:
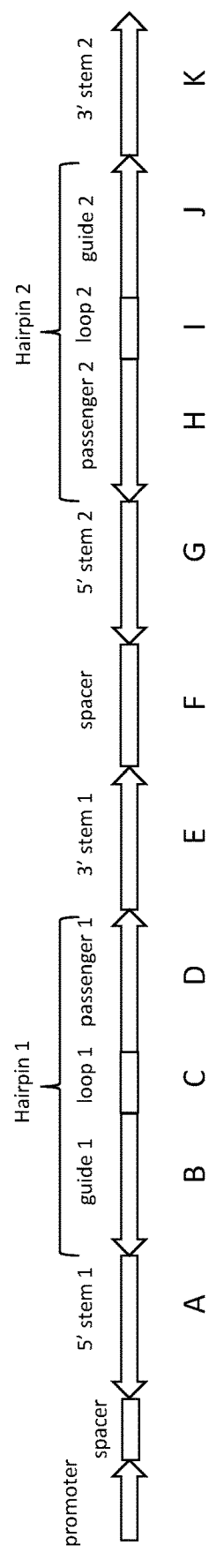

FIGS. 2A-B: Schematic representation of part of a multi-hairpin amiRNA gene.

The processing of hairpin sequences comprising guide strand sequences, unstructured loops and passenger strand sequences to produce guide strand sequences loaded into the RISC complex for inhibition of target gene expression is improved if the amiRNA gene comprises additional features. These include additional stem structures to the 5' and 3' of the hairpin sequences. Element A is a sequence that is complementary to element E, and which stabilizes hairpin 1, although the complementarity between elements A and E does not need to be perfect to perform this function. Similarly, element G is a sequence that is complementary to element K, and which stabilizes hairpin 2, although the complementarity between elements A and E does not need to be perfect to perform this function. Optionally hairpins are separated by an unstructured spacer element F. Two or more hairpins are operably linked to the same promoter, and the first hairpin is separated from the promoter by a spacer sequence. Hairpin 1 is shown in a configuration with guide followed by loop followed by passenger, Hairpin 2 is shown in this same configuration in FIG. 2A, but in a passenger-loop-guide configuration in FIG. 2B. Any other combinations of configurations are acceptable. Additional hairpins may be placed following the second hairpin. Optionally the final hairpin in a multi-hairpin amiRNA gene is followed by a polyadenylation signal sequence.

FIGS. 3A-G: Mass spectra of antibodies comprising glycans produced by stably transfected CHO lines expressing multi-hairpin amiRNA genes targeting FUT8. Protein was purified from antibody-producing cells as described in Section 6.1.1.1 and analyzed by mass spectroscopy. Arrows indicate the predicted molecular weights of (i) 50,424 Da, the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms; (ii) 50,571 Da, the heavy chain modified by $G_{0F}$: the conserved heptasccharide core plus a fucose residue; (iii) 50,586 Da, the heavy chain modified by Gi: the conserved heptasccharide core plus a galactose residue and (iv) 50,733 Da, the heavy chain modified by Gi: the conserved heptasccharide core plus a galactose residue plus a fucose residue. In all cases the heavy chain has also lost its C-terminal lysine residue. 3A: no amiRNA transposon; 3B-G: multi-hairpin amiRNA transposons configured as shown in FIGS. 1A-B.

FIGS. 4A-D: Mass spectra of antibodies comprising glycans produced by stably transfected CHO lines expressing multi-amiRNA sequences linked to different promoters. Protein was purified from antibody-producing cells as described in Section 6.1.1.2 and analyzed by mass spectroscopy. Arrows indicate the predicted molecular weights of (i) 50,424 Da, the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms; (ii) 50,570 Da, the heavy chain modified by $G_{0F}$: the conserved heptasccharide core plus a fucose residue; (iii) 23,443 Da, the light chain. In all cases the heavy chain has also lost its C-terminal lysine residue. 4A: no amiRNA transposon; 4B: multi-hairpin amiRNA SEQ ID NO: 726 operably linked to an EEF2 promoter; 4C: multi-hairpin amiRNA SEQ ID NO: 726 operably linked to a PGK promoter; 4D: multi-hairpin amiRNA SEQ ID NO: 726 operably linked to a Ubb promoter.

Figure 5A:
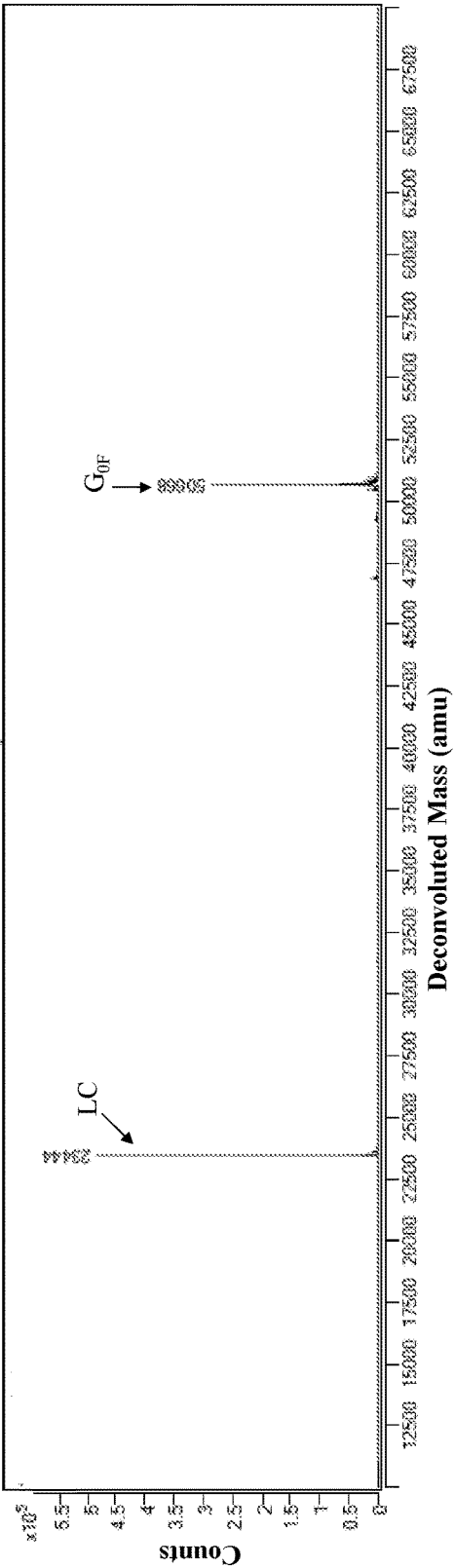
Figure 5B:
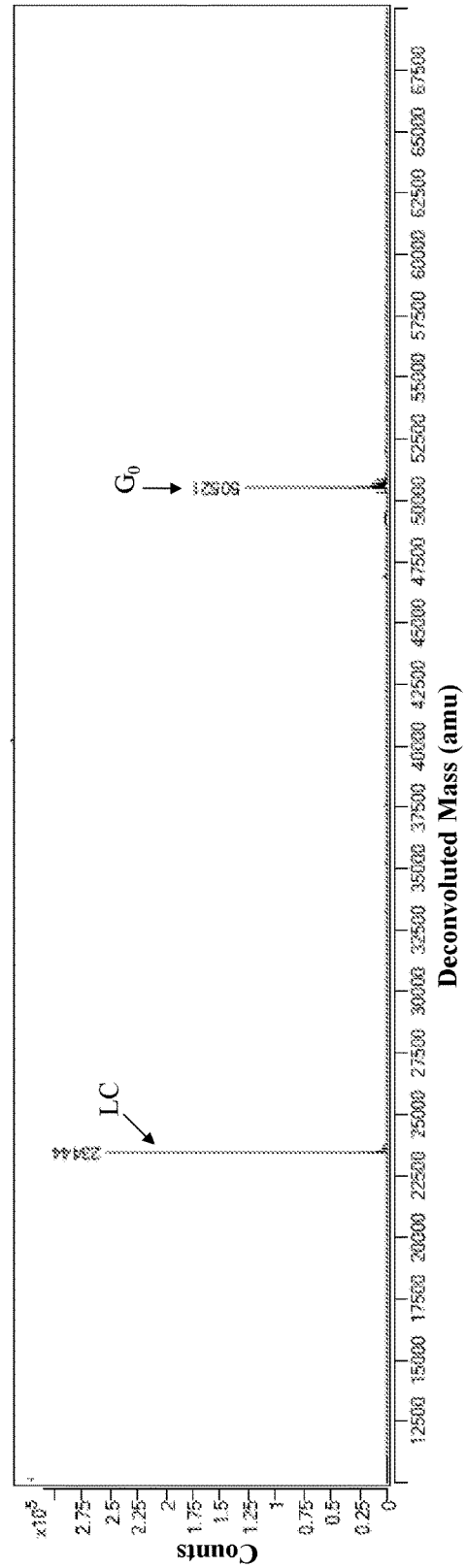

FIGS. 5A-B: Mass spectra of antibodies comprising glycans produced by CHO lines expressing multi-amiRNA genes and subsequently transiently transfected with antibody genes. Protein was purified from antibody-producing cells as described in Section 6.1.1.3 and analyzed by mass spectroscopy. Arrows indicate the predicted molecular weights of (i) 50,521 Da, the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms; (ii) 50,668 Da, the heavy chain modified by $G_{0F}$: the conserved heptasccharide core plus a fucose residue; (iii) 23,444 Da, the light chain. In all cases the heavy chain has also lost its C-terminal lysine residue. 5A: no amiRNA transposon; 5B: multi-hairpin amiRNA SEQ ID NO: 726 operably linked to an EF1 promoter.

5. DESCRIPTION

5.1 Definitions

Use of the singular forms "a," "an," and "the" include plural references unless the context clearly dictates otherwise. Thus, for example, reference to "a polynucleotide" includes a plurality of polynucleotides, reference to "a substrate" includes a plurality of such substrates, reference to "a variant" includes a plurality of variants, and the like.

Terms such as "connected," "attached," "linked," and "conjugated" are used interchangeably herein and encompass direct as well as indirect connection, attachment, linkage or conjugation unless the context clearly dictates otherwise. Where a range of values is recited, it is to be understood that each intervening integer value, and each fraction thereof, between the recited upper and lower limits of that range is also specifically disclosed, along with each subrange between such values. The upper and lower limits of any range can independently be included in or excluded from the range, and each range where either, neither or both limits are included is also encompassed within the invention. Where a value being discussed has inherent limits, for example where a component can be present at a concentration of from 0 to 100%, or where the pH of an aqueous solution can range from 1 to 14, those inherent limits are specifically disclosed. Where a value is explicitly recited, it is to be understood that values which are about the same quantity or amount as the recited value are also within the scope of the invention. Where a combination is disclosed, each sub combination of the elements of that combination is also specifically disclosed and is within the scope of the invention. Conversely, where different elements or groups of elements are individually disclosed, combinations thereof are also disclosed. Where any element of an invention is disclosed as having a plurality of alternatives, examples of that invention in which each alternative is excluded singly or in any combination with the other alternatives are also hereby disclosed; more than one element of an invention can have such exclusions, and all combinations of elements having such exclusions are hereby disclosed.

Unless defined otherwise herein, all technical and scientific terms used herein have the same meaning as commonly understood by one of ordinary skill in the art to which this invention belongs. Singleton, et. al., *Dictionary of Microbiology and Molecular Biology*, 2nd Ed., John Wiley and Sons, New York (1994), and Hale & Marham, *The Harper Collins Dictionary of Biology*, Harper Perennial, N.Y., 1991, provide one of skill with a general dictionary of many of the terms used in this invention. Although any methods and materials similar or equivalent to those described herein can be used in the practice or testing of the present invention, the preferred methods and materials are described. Unless otherwise indicated, nucleic acids are written left to right in 5' to 3' orientation; amino acid sequences are written left to right in amino to carboxy orientation, respectively. The terms defined immediately below are more fully defined by reference to the specification as a whole.

An "artificial micro-RNA" or "amiRNA" is a sequence comprising a natural microRNA scaffold in which the guide and/or passenger strand sequences have been modified such that the guide strand is directed to an mRNA target other than the natural target. Other parts of the natural micro-RNA scaffold may also be modified, for example to improve processing by enzymes in the RNA interference pathway. An amiRNA sequence that comprises two or more guide and passenger strands operably linked to the same promoter is referred to as a "multi-hairpin amiRNA gene".

The term "codon usage" or "codon bias" refers to the relative frequencies with which different synonymous codons are used to encode an amino acid within an open reading frame. A nucleic acid sequence having codon preferences for a particular target cell has a balance of synonymous codon choices that result in efficient translation in that cell type. This balance is often not calculable from observed genomic codon frequencies, but must be empirically determined, for example as described in U.S. Pat. Nos. 7,561,972 and 7,561,973 and 8,401,798 and in Welch et. al. (2009) "Design Parameters to Control Synthetic Gene Expression in *Escherichia coli* ". PLoS ONE 4(9): e7002. world wide web doi.org/10.1371/joumal.pone.0007002. A nucleic acid originally isolated from one cell type to be introduced into a target cell of another type can undergo selection of codon preferences for the target site cell such that at least 1 and sometimes, 5, 20, 15, 20, 50, 100 or more choices among synonymous codons differ between the nucleic acid introduced into the target cell from the original nucleic acid.

Two polynucleotides are "complementary" if the bases of one hydrogen bond to the bases of the other. For perfect complementarity, adenine (A) in the first polynucleotide must correspond with thymine (T) in the second (and vice versa), and cytosine (C) in the first polynucleotide must correspond with guanine (G) in the second (and vice versa). The two polynucleotides must also be antiparallel. If two polynucleotides are complementary, one may be described as the "reverse complement" of the other to indicate that their bases are complementary when one is in the 5' to 3' direction and the other is in the 3' to 5' direction. As used herein, when one polynucleotide sequence is described as complementary to another, it is intended to indicate that the sequences are antiparallel and able to base-pair with one another.

The "configuration" of a polynucleotide means the functional sequence elements within the polynucleotide, and the order and direction of those elements.

The terms "corresponding transposon" and "corresponding transposase" are used to indicate an activity relationship between a transposase and a transposon. A transposase transposes its corresponding transposon. Many transposases may correspond with a single transposon, and many transposons may correspond with a single transposase.

The term "counter-selectable marker" means a polynucleotide sequence that confers a selective disadvantage on a host cell. Examples of counter-selectable markers include sacB, rpsL, tetAR, pheS, thyA, gata-1, ccdB, kid and barnase (Bernard, 1995, Journal/Gene, 162: 159-160; Bernard et. al., 1994. Journal/Gene, 148: 71-74; Gabant et. al., 1997, Journal/Biotechniques, 23: 938-941; Gababt et. al., 1998, Journal/Gene, 207: 87-92; Gababt et. al., 2000, Journal/Biotechniques, 28: 784-788; Galvao and de Lorenzo, 2005, Journal/Appl Environ Microbiol, 71: 883-892; Hartzog et. al., 2005, Journal/Yeat, 22:789-798; Knipfer et. al., 1997, Journal/Plasmid, 37: 129-140; Reyrat et. al., 1998, Journal/Infect Immun, 66: 4011-4017; Soderholm et. al., 2001, Journal/Biotechniques, 31: 306-310, 312; Tamura et. al., 2005, Journal/ Appl Environ Microbiol, 71: 587-590; Yazynin et. al., 1999, Journal/FEBS Lett, 452: 351-354). Counter-selectable markers often confer their selective disadvantage in specific contexts. For example, they may confer sensitivity to compounds that can be added to the environment of the host cell, or they may kill a host with one genotype but not kill a host with a different genotype. Conditions which do not confer a selective disadvantage on a cell carrying a counter-selectable marker are described as "permissive". Conditions which do confer a selective disadvantage on a cell carrying a counter-selectable marker are described as "restrictive".

The term "coupling element" or "translational coupling element" means a DNA sequence that allows the expression of a first polypeptide to be linked to the expression of a second polypeptide. Internal ribosome entry site elements (IRES elements) and cis-acting hydrolase elements (CHYSEL elements) are examples of coupling elements.

The terms "DNA sequence", "RNA sequence" or "polynucleotide sequence" mean a contiguous nucleic acid sequence. The sequence can be an oligonucleotide of 2 to 20 nucleotides in length to a full length genomic sequence of thousands or hundreds of thousands of base pairs.

The term "expression construct" means any polynucleotide designed to transcribe an RNA. For example, a construct that contains at least one promoter which is or may be operably linked to a downstream gene, coding region, or polynucleotide sequence (for example, a cDNA or genomic DNA fragment that encodes a polypeptide or protein, or an RNA effector molecule, for example, an antisense RNA, triplex-forming RNA, ribozyme, an artificially selected high affinity RNA ligand (aptamer), a double-stranded RNA, for example, an RNA molecule comprising a stem-loop or hairpin dsRNA, or a bi-finger or multi-finger dsRNA or a microRNA, or any RNA). An "expression vector" is a polynucleotide comprising a promoter which can be operably linked to a second polynucleotide. Transfection or transformation of the expression construct into a recipient cell allows the cell to express an RNA effector molecule, polypeptide, or protein encoded by the expression construct. An expression construct may be a genetically engineered plasmid, virus, recombinant virus, or an artificial chromosome derived from, for example, a bacteriophage, adenovirus, adeno-associated virus, retrovirus, lentivirus, poxvirus, or herpesvirus. Such expression vectors can include sequences from bacteria, viruses or phages. Such vectors include chromosomal, episomal and virus-derived vectors, for example, vectors derived from bacterial plasmids, bacteriophages, yeast episomes, yeast chromosomal elements, and viruses, vectors derived from combinations thereof, such as those derived from plasmid and bacteriophage genetic elements, cosmids and phagemids. An expression construct can be replicated in a living cell, or it can be made synthetically. For purposes of this application, the terms "expression construct", "expression vector", "vector", and "plasmid" are used interchangeably to demonstrate the application of the invention in a general, illustrative sense, and are not intended to limit the invention to a particular type of expression construct.

The term "expression polypeptide" means a polypeptide encoded by a gene on an expression construct.

The term "expression system" means any in vivo or in vitro biological system that is used to produce one or more gene product encoded by a polynucleotide.

A "gene" refers to a transcriptional unit including a promoter and sequence to be expressed from it as an RNA or protein. The sequence to be expressed can be genomic or cDNA or one or more non-coding RNAs including siRNAs or microRNAs among other possibilities. Other elements, such as introns, and other regulatory sequences may or may not be present.

A "gene transfer system" comprises a vector or gene transfer vector, or a polynucleotide comprising the gene to be transferred which is cloned into a vector (a "gene transfer polynucleotide" or "gene transfer construct"). A gene transfer system may also comprise other features to facilitate the process of gene transfer. For example, a gene transfer system may comprise a vector and a lipid or viral packaging mix for enabling a first polynucleotide to enter a cell, or it may comprise a polynucleotide that includes a transposon and a second polynucleotide sequence encoding a corresponding transposase to enhance productive genomic integration of the transposon. The transposases and transposons of a gene transfer system may be on the same nucleic acid molecule or on different nucleic acid molecules. The transposase of a gene transfer system may be provided as a polynucleotide or as a polypeptide.

The "guide" strand of an inhibitory double stranded RNA such as an shRNA or a miRNA is the strand that binds to the RNA-induced silencing complex (RISC) and participates in gene silencing. The guide strand sequence is the reverse complement of a target mRNA sequence, whose expression it inhibits.

The term "hairpin" is used to describe a polynucleotide sequence in which two regions of the same strand are reverse complements of each other in nucleotide sequence, resulting in intramolecular base pairing to form a double-stranded region and an unpaired loop. The term is used herein to describe the DNA sequence that encodes such a structure, although normally DNA is double-stranded through intermolecular base-pairing. The term is also used to refer to the RNA sequence that adopts the hairpin structure. DNA hairpins of the present invention are intended for expression as RNA. An RNA hairpin of the present invention is intended as a substrate for the RNA interference pathway enzymes to be processed into a guide strand loaded onto the RISC complex. The "guide strand" of a hairpin is the sequence that, after transcription and processing, is loaded into the RISC complex. The guide strand is complementary to the target mRNA.

Two elements are "heterologous" to one another if not naturally associated. For example, a nucleic acid sequence encoding a protein linked to a heterologous promoter means a promoter other than that which naturally drives expression of the protein. A heterologous nucleic acid flanked by transposon ends or ITRs means a heterologous nucleic acid not naturally flanked by those transposon ends or ITRs, such as a nucleic acid encoding a polypeptide other than a transposase, including an antibody heavy or light chain. A nucleic acid is heterologous to a cell if not naturally found in the cell or if naturally found in the cell but in a different location (e.g., episomal or different genomic location) than the location described.

A "hyperactive" transposase is a transposase that is more active than the naturally occurring transposase from which it is derived. "Hyperactive" transposases are thus not naturally occurring sequences.

The term "host" means any prokaryotic or eukaryotic organism that can be a recipient of a nucleic acid. A "host," as the term is used herein, includes prokaryotic or eukaryotic organisms that can be genetically engineered. For examples of such hosts, see Maniatis et. al., Molecular Cloning. A Laboratory Manual, Cold Spring Harbor Laboratory, Cold Spring Harbor, N.Y. (1982). As used herein, the terms "host," "host cell," "host system" and "expression host" can be used interchangeably.

An "IRES" or "internal ribosome entry site" means a specialized sequence that directly promotes ribosome binding, independent of a cap structure.

An 'isolated' polypeptide or polynucleotide means a polypeptide or polynucleotide that has been either removed from its natural environment, produced using recombinant techniques, or chemically or enzymatically synthesized. Polypeptides or polynucleotides of this invention may be purified, that is, essentially free from any other polypeptide or polynucleotide and associated cellular products or other impurities.

The terms "nucleoside" and "nucleotide" include those moieties which contain not only the known purine and pyrimidine bases, but also other heterocyclic bases which have been modified. Such modifications include methylated purines or pyrimidines, acylated purines or pyrimidines, or other heterocycles. Modified nucleosides or nucleotides can also include modifications on the sugar moiety, for example, where one or more of the hydroxyl groups are replaced with halogen, aliphatic groups, or is functionalized as ethers, amines, or the like. The term "nucleotidic unit" is intended to encompass nucleosides and nucleotides.

An "Open Reading Frame" or "ORF" means a portion of a polynucleotide that, when translated into amino acids, contains no stop codons. The genetic code reads DNA sequences in groups of three base pairs, which means that a double-stranded DNA molecule can read in any of six possible reading frames-three in the forward direction and three in the reverse. An ORF typically also includes an initiation codon at which translation may start.

The term "operably linked" refers to functional linkage between two sequences such that one sequence modifies the behavior of the other. For example, a first polynucleotide comprising a nucleic acid expression control sequence (such as a promoter, IRES sequence, enhancer or array of transcription factor binding sites) and a second polynucleotide are operably linked if the first polynucleotide affects transcription and/or translation of the second polynucleotide. Similarly, a first amino acid sequence comprising a secretion signal or a subcellular localization signal and a second amino acid sequence are operably linked if the first amino acid sequence causes the second amino acid sequence to be secreted or localized to a subcellular location.

The term "orthogonal" refers to a lack of interaction between two systems. A first transposon and its corresponding first transposase and a second transposon and its corresponding second transposase are orthogonal if the first transposase does not excise or transpose the second transposon and the second transposase does not excise or transpose the first transposon.

The term "overhang" or "DNA overhang" means the single-stranded portion at the end of a double-stranded DNA molecule. Complementary overhangs are those which will base-pair with each other.

The "passenger" strand of an inhibitory double stranded RNA such as an shRNA or a miRNA is the strand that is degraded after transport to the cytoplasm and does not participate directly in gene silencing.

A "piggyBac-like transposase" means a transposase with at least 20% sequence identity as identified using the TBLASTN algorithm to the piggyBac transposase from *Trichoplusia ni* (SEQ ID NO: 1047), and as more fully described in Sakar, A. et. al., 2003. Mol. Gen. Genomics 270: 173-180. "Molecular evolutionary analysis of the widespread piggyBac transposon family and related 'domesticated' species", and further characterized by a DDE-like DDD motif, with aspartate residues at positions corresponding to D268, D346, and D447 of *Trichoplusia ni* piggyBac transposase on maximal alignment. PiggyBac-like transposases are also characterized by their ability to excise their transposons precisely with a high frequency. A "piggyBac-like transposon" means a transposon having transposon ends which are the same or at least 80% and preferably at least 90, 95, 96, 97, 98, 99% or 100% identical to the transposon ends of a naturally occurring transposon that encodes a piggyBac-like transposase. A piggyBac-like transposon includes an inverted terminal repeat (ITR) sequence of approximately 12-16 bases at each end. These repeats may be identical at the two ends, or the repeats at the two ends may differ at 1 or 2 or 3 or 4 positions in the two ITRs. The transposon is flanked on each side by a 4 base sequence corresponding to the integration target sequence which is duplicated on transposon integration (the Target Site Duplication or Target Sequence Duplication or TSD). PiggyBac-like transposons and transposases occur naturally in a wide range of organisms including *Argyrogramma agnate* (GU477713), *Anopheles gambiae* (XP_312615; XP 320414; XP 310729), *Aphis gossypii* (GU329918), *Acyrthosiphon pisum* (XP_001948139), *Agrotis ypsilon* (GU477714), *Bombyx mori* (BAD11135), *Ciona intestinalis* (XP 002123602), *Chilo suppressalis* (JX294476), *Drosophila melanogaster* (AAL39784), *Daphnia pulicaria* (AAM76342), *Helicoverpa armigera* (ABS18391), *Homo sapiens* (NP 689808), *Heliothis virescens* (ABD76335), *Macdunnoughia crassisigna* (EU287451), *Macaca fascicularis* (AB179012), *Mus musculus* (NP 741958), *Pectinophora gossypiella* (GU270322), *Rattus norvegicus* (XP 220453), *Tribolium castaneum* (XP 001814566) and *Trichoplusia ni* (AAA87375) and *Xenopus tropicalis* (BAF82026), although transposition activity has been described for almost none of these.

The terms "polynucleotide," "oligonucleotide," "nucleic acid" and "nucleic acid molecule" are used interchangeably to refer to a polymeric form of nucleotides of any length, and may comprise ribonucleotides, deoxyribonucleotides, analogs thereof, or mixtures thereof. This term refers only to the primary structure of the molecule. Thus, the term includes triple-, double- and single-stranded deoxyribonucleic acid ("DNA"), as well as triple-, double- and single-stranded ribonucleic acid ("RNA"). It also includes modified, for example by alkylation, and/or by capping, and unmodified forms of the polynucleotide. More particularly, the terms "polynucleotide," "oligonucleotide," "nucleic acid" and "nucleic acid molecule" include polydeoxyribonucleotides (containing 2-deoxy-D-ribose), polyribonucleotides (containing D-ribose), including tRNA, rRNA, hRNA, siRNA and mRNA, whether spliced or unspliced, any other type of polynucleotide which is an N-or C-glycoside of a purine or pyrimidine base, and other polymers containing non-nucleotidic backbones, for example, polyamide (for example, peptide nucleic acids ("PNAs")) and polymorpholino (commercially available from the Anti-Virals, Inc., Corvallis, Oreg., as Neugene) polymers, and other synthetic sequence-specific nucleic acid polymers providing that the polymers contain nucleobases in a configuration which allows for base pairing and base stacking, such as is found in DNA and RNA. There is no intended distinction in length between the terms "polynucleotide," "oligonucleotide," "nucleic acid" and "nucleic acid molecule," and these terms are used interchangeably herein. These terms refer only to the primary structure of the molecule. Thus, these terms include, for example, 3'-deoxy-2', 5'-DNA, oligodeoxyribonucleotide N3' P5' phosphoramidates, 2'-O-alkyl-substituted RNA, double- and single-stranded DNA, as well as double- and single-stranded RNA, and hybrids thereof including for example hybrids between DNA and RNA or between PNAs and DNA or RNA, and also include known types of modifications, for example, labels, alkylation, "caps," substitution of one or more of the nucleotides with an analog, internucleotide modifications such as, for example, those with uncharged linkages (for example, methyl phosphonates, phosphotriesters, phosphoramidates, carbamates, or the like) with negatively charged linkages (for example, phosphorothioates, phosphorodithioates, or the like), and with positively charged linkages (for example, aminoalkylphosphoramidates, aminoalkylphosphotriesters), those containing pendant moieties, such as, for example, proteins (including enzymes (for example, nucleases), toxins, antibodies, signal peptides, poly-L-lysine, or the like), those with intercalators (for example, acridine, psoralen, or the like), those containing chelates (of, for example, metals, radioactive metals, boron, oxidative metals, or the like), those containing alkylators, those with modified linkages (for example, alpha anomeric nucleic acids, or the like), as well as unmodified forms of the polynucleotide or oligonucleotide.

A "promoter" means a nucleic acid sequence sufficient to direct transcription of an operably linked nucleic acid molecule. A promoter can be used with or without other transcription control elements (for example, enhancers) that are sufficient to render promoter-dependent gene expression controllable in a cell type-specific, tissue-specific, or temporal-specific manner, or that are inducible by external signals or agents; such elements, may be within the 3' region of a gene or within an intron. Desirably, a promoter is operably linked to a nucleic acid sequence, for example, a cDNA or a gene sequence, or an effector RNA coding sequence, in such a way as to enable expression of the nucleic acid sequence, or a promoter is provided in an expression cassette into which a selected nucleic acid sequence to be transcribed can be conveniently inserted. A regulatory element such as promoter active in a mammalian cells means a regulatory element configurable to result in a level of expression of at least 1 transcript per cell in a mammalian cell into which the regulatory element has been introduced.

"RNA interference" is a biological process in which RNA molecules inhibit gene expression or translation, by neutralizing targeted mRNA molecules. Historically, RNAi was known by other names, including co-suppression, post-transcriptional gene silencing (PTGS), and quelling. Micro RNAs, including artificial micro RNAs, inhibit gene expression through RNA interference.

The term "selectable marker" means a polynucleotide segment or expression product thereof that allows one to select for or against a molecule or a cell that contains it, often under particular conditions. These markers can encode an activity, such as, but not limited to, production of RNA, peptide, or protein, or can provide a binding site for RNA, peptides, proteins, inorganic and organic compounds or compositions. Examples of selectable markers include but are not limited to: (1) DNA segments that encode products which provide resistance against otherwise toxic compounds (e.g., antibiotics); (2) DNA segments that encode products which are otherwise lacking in the recipient cell (e.g., tRNA genes, auxotrophic markers); (3) DNA segments that encode products which suppress the activity of a gene product; (4) DNA segments that encode products which can be readily identified (e.g., phenotypic markers such as beta-galactosidase, green fluorescent protein (GFP), and cell surface proteins); (5) DNA segments that bind products which are otherwise detrimental to cell survival and/or function; (6) DNA segments that otherwise inhibit the activity of any of the DNA segments described in Nos. 1-5 above (e.g., antisense oligonucleotides); (7) DNA segments that bind products that modify a substrate (e.g. restriction endonucleases); (8) DNA segments that can be used to isolate a desired molecule (e.g. specific protein binding sites); (9) DNA segments that encode a specific nucleotide sequence which can be otherwise non-functional (e.g., for PCR amplification of subpopulations of molecules); and/or (10) DNA segments, which when absent, directly or indirectly confer sensitivity to particular compounds.

Sequence identity can be determined by aligning sequences using algorithms, such as BESTFIT, FASTA, and TFASTA in the Wisconsin Genetics Software Package Release 7.0, Genetics Computer Group, 575 Science Dr., Madison, Wis.), using default gap parameters, or by inspection, and the best alignment (i.e., resulting in the highest percentage of sequence similarity over a comparison window). Percentage of sequence identity is calculated by comparing two optimally aligned sequences over a window of comparison, determining the number of positions at which the identical residues occurs in both sequences to yield the number of matched positions, dividing the number of matched positions by the total number of matched and mismatched positions not counting gaps in the window of comparison (i.e., the window size), and multiplying the result by 100 to yield the percentage of sequence identity. Unless otherwise indicated the window of comparison between two sequences is defined by the entire length of the shorter of the two sequences.

A "target nucleic acid" is a nucleic acid into which a transposon is to be inserted. Such a target can be part of a chromosome, episome or vector.

An "integration target sequence" or "target sequence" or "target site" for a transposase is a site or sequence in a target DNA molecule into which a transposon can be inserted by a transposase. The piggyBac transposase from *Trichoplusia ni* inserts its transposon predominantly into the target sequence 5'-TTAA-3'. Other useable target sequences for piggyBac transposons are 5'-CTAA-3', 5'-TTAG-3', 5'-ATAA-3', 5'-TCAA-3', 5'-AGTT-3', 5'-ATTA-3', 5'-GTTA-3', 5'-TTGA-3', 5'-TTTA-3', 5'-TTAC-3', 5'-ACTA-3', 5'-AGGG-3', 5'-CTAG-3', 5'-GTAA-3', 5'-AGGT-3', 5'-ATCA-3', 5'-CTCC-3', 5'-TAAA-3', 5'-TCTC-3', 5'-TGAA-3', 5'-AAAT-3', 5'-AATC-3', 5'-ACAA-3', 5'-ACAT-3', 5'-ACTC-3', 5'-AGTG-3', 5'-ATAG-3', 5'-CAAA-3', 5'-CACA-3', 5'-CATA-3', 5'-CCAG-3', 5'-CCCA-3', 5'-CGTA-3', 5'-CTGA-3', 5'-GTCC-3', 5'-TAAG-3', 5'-TCTA-3', 5'-TGAG-3', 5'-TGTT-3', 5'-TTCA-3', 5'-TTCT-3' and 5'-TTTT-3' (Li et al., 2013. Proc. Natl. Acad. Sci vol. 110, no. 6, E478-487) and 5'-TTAT. PiggyBac-like transposases transpose their transposons using a cut-and-paste mechanism, which results in duplication of their 4 base pair target sequence on insertion into a DNA molecule. The target sequence is thus found on each side of an integrated piggyBac-like transposon.

The term "translation" refers to the process by which a polypeptide is synthesized by a ribosome 'reading' the sequence of a polynucleotide.

A 'transposase' is a polypeptide that catalyzes the excision of a corresponding transposon from a donor polynucleotide, for example a vector, and (providing the transposase is not integration-deficient) the subsequent integration of the transposon into a target nucleic acid.

The term "transposition" is used herein to mean the action of a transposase in excising a transposon from one polynucleotide and then integrating it, either into a different site in the same polynucleotide, or into a second polynucleotide.

The term "transposon" means a polynucleotide that can be excised from a first polynucleotide, for instance, a vector, and be integrated into a second position in the same polynucleotide, or into a second polynucleotide, for instance, the genomic or extrachromosomal DNA of a cell, by the action of a corresponding trans-acting transposase. A transposon comprises a first transposon end and a second transposon end, which are polynucleotide sequences recognized by and transposed by a transposase. A transposon usually further comprises a first polynucleotide sequence between the two transposon ends, such that the first polynucleotide sequence is transposed along with the two transposon ends by the action of the transposase. This first polynucleotide in natural transposons frequently comprises an open reading frame encoding a corresponding transposase that recognizes and transposes the transposon. Transposons of the present invention are "synthetic transposons" comprising a heterologous polynucleotide sequence which is transposable by virtue of its juxtaposition between two transposon ends. Synthetic transposons may or may not further comprise flanking polynucleotide sequence(s) outside the transposon ends, such as a sequence encoding a transposase, a vector sequence or sequence encoding a selectable marker.

The term "transposon end" means the cis-acting nucleotide sequences that are sufficient for recognition by and transposition by a corresponding transposase. Transposon ends of piggyBac-like transposons comprise perfect or imperfect repeats such that the respective repeats in the two transposon ends are reverse complements of each other. These are referred to as inverted terminal repeats (ITR) or terminal inverted repeats (TIR). A transposon end may or may not include additional sequence proximal to the ITR that promotes or augments transposition.

The term "vector" or "DNA vector" or "gene transfer vector" refers to a polynucleotide that is used to perform a "carrying" function for another polynucleotide. For example, vectors are often used to allow a polynucleotide to be propagated within a living cell, or to allow a polynucleotide to be packaged for delivery into a cell, or to allow a polynucleotide to be integrated into the genomic DNA of a cell. A vector may further comprise additional functional elements, for example it may comprise a transposon.

5.2 Genetic Elements Useful for Expression in Cultured Mammalian Cells

5.2.1 Gene Transfer Systems

Gene transfer systems comprise a polynucleotide to be transferred to a host cell. The gene transfer system may comprise any of the transposons described herein together with their corresponding transposases. Although transposons are preferred gene transfer systems because of their large cargo sizes and because multiple different open reading frames with all of their associated regulatory elements can be incorporated without compromising packaging and delivery of the gene transfer system, a gene transfer system for delivery of an inhibitory gene transfer polynucleotide may comprise one or more polynucleotides that have other features that facilitate efficient gene transfer without the need for a transposase or transposon, for example a viral system such as a lentiviral system, an adenoviral system or an adeno-associated viral system.

The components of the gene transfer system may be transfected into one or more cells by techniques such as particle bombardment, electroporation, microinjection, combining the components with lipid-containing vesicles, such as cationic lipid vesicles, DNA condensing reagents (example, calcium phosphate, polylysine or polyethyleneimine), and inserting the components (that is the nucleic acids thereof into a viral vector and contacting the viral vector with the cell. Where a viral vector is used, the viral vector can include any of a variety of viral vectors known in the art including viral vectors selected from the group consisting of a retroviral vector, an adenovirus vector or an adeno-associated viral vector. A retroviral vector may be a lentiviral vector comprising two LTRs each of which is at least 90% identical to a sequence selected from SEQ ID NOs: 115-116. An adeno-associated viral vector may comprise two ITRs each of which is at least 90% identical to a sequence selected from SEQ ID NOs: 1117-1123. The gene transfer system may be formulated in a suitable manner as known in the art, or as a pharmaceutical composition or kit.

The consistency of expression of a gene from a heterologous polynucleotide in a cultured mammalian cell can be improved if the heterologous polynucleotide is integrated into the genome of the host cell. Integration of a polynucleotide into the genome of a host cell also generally makes it stably heritable, by subjecting it to the same mechanisms that ensure the replication and division of genomic DNA. Such stable heritability is desirable for achieving good and consistent expression over long growth periods. For stable modification of cultured mammalian cells, including the consistent expression of inhibitory RNAs such as miRNAs and amiRNAs, the stability of the modification and consistency of expression levels are important, particularly for therapeutic applications.

5.2.2 Transposon Elements

Heterologous polynucleotides may be more efficiently integrated into a target genome if they are part of a transposon, for example so that they may be integrated by a transposase. A particular benefit of a transposon is that the entire polynucleotide between the transposon ITRs is integrated. This is in contrast with random integration, where a polynucleotide introduced into a eukaryotic cell is often fragmented at random in the cell, and only parts of the polynucleotide become incorporated into the target genome, usually at a low frequency. There are several different classes of transposon. piggyBac-like transposons include the piggyBac transposon from the looper moth *Trichoplusia ni*, Xenopus piggyBac-like transposons, *Bombyx* piggyBac-like transposons, *Heliothis* piggyBac-like transposons, *Helicoverpa* piggyBac-like transposons, *Agrotis* piggyBac-lkike transposons, *Amyelois* piggyBac-like transposons, piggyBat piggyBac-like transposons and *Oryzias* piggyBac-like transposons. hAT transposons include TcBuster. Mariner transposons include Sleeping Beauty. Each of these transposons can be integrated into the genome of a mammalian cell by a corresponding transposase. Heterologous polynucleotides incorporated into transposons may be integrated into cultured mammalian cells, as well as hepatocytes, neural cells, muscle cells, blood cells, embryonic stem cells, somatic stem cells, hematopoietic cells, embryos, zygotes and sperm cells (some of which are open to be manipulated in an in vitro setting). Preferred cells can also be pluripotent cells (cells whose descendants can differentiate into several restricted cell types, such as hematopoietic stem cells or other stem cells) or totipotent cells (i.e., a cell whose descendants can become any cell type in an organism, e.g., embryonic stem cells).

Preferred gene transfer systems, including inhibitory polynucleotides comprising sequences for the expression of inhibitory RNAs, comprise a transposon in combination with a corresponding transposase protein that transposases the transposon, or a nucleic acid that encodes the corresponding transposase protein and is expressible in the target cell.

When there are multiple components of a gene transfer system, for example one or more polynucleotides comprising transposon ends flanking genes for expression in the target cell, and a transposase (which may be provided either as a protein or encoded by a nucleic acid), these components can be transfected into a cell at the same time, or sequentially. For example, a transposase protein or its encoding nucleic acid may be transfected into a cell prior to, simultaneously with or subsequently to transfection of a corresponding transposon. Additionally, administration of either component of the gene transfer system may occur repeatedly, for example, by administering at least two doses of this component.

Transposase proteins may be encoded by polynucleotides including RNA or DNA. Preferable RNA molecules include those with appropriate substitutions to reduce toxicity effects on the cell, for example substitution of uridine with pseudouridine, and substitution of cytosine with 5-methyl cytosine. mRNA encoding the transposase may be prepared such that it has a 5'-cap structure to improve expression in a target cell. Exemplary cap structures are a cap analog (G(5')ppp(5')G), an anti-reverse cap analog (3'-O-Me-m$^7$G (5')ppp(5')G, a clean cap (m7G(5')ppp(5')(2'OMeA)pG), an mCap (m7G(5')ppp(5)G). mRNA encoding the transposase may be prepared such that some bases are partially or fully substituted, for example uridine may be substituted with pseudo-uridine, cytosine may be substituted with 5-methyl-cytosine. Any combinations of these caps and substitutions may be made. Similarly, the nucleic acid encoding the transposase protein or the transposon of this invention can be transfected into the cell as a linear fragment or as a circularized fragment, either as a plasmid or as recombinant viral DNA. If the transposase is introduced as a DNA sequence encoding the transposase, then the open reading frame encoding the transposase is preferably operably linked to a promoter that is active in the target mammalian cell.

An advantageous piggyBac-like transposon for modifying the genome of a mammalian cell is a *Xenopus* transposon which comprises an ITR with the with sequence given by SEQ ID NO: 1004, a heterologous polynucleotide to be transposed and a second ITR with sequence given by SEQ ID NO: 1005. The transposon may further be flanked by a copy of the tetranucleotide 5'-TTAA-3' on each side, immediately adjacent to the ITRs and distal to the heterologous polynucleotide. The transposon may further comprise a sequence immediately adjacent to the ITR and proximal to the heterologous polynucleotide that is at least 95% identical to SEQ ID NO: 1000 or 1001 on one side of the heterologous polynucleotide, preferably the left side, and a sequence immediately adjacent to the ITR and proximal to the heterologous polynucleotide that is at least 95% identical to SEQ ID NO: 1002 or 1003 on the other side of the heterologous polynucleotide, preferably the right side. This transposon may be transposed by a corresponding Xenopus transposase comprising a sequence at least 90% identical to the sequence given by SEQ ID NO: 1049 or 1050, for example any of SEQ ID NOs: 1049-1081. Preferably the transposase is a hyperactive variant of a naturally occurring transposase. Preferably the hyperactive variant transposase comprises one or more of the following amino acid changes, relative to the sequence of SEQ ID NO: 1049: Y6L, Y6H, Y6V, Y6I, Y6C, Y6G, Y6A, Y6S, Y6F, Y6R, Y6P, Y6D, Y6N, S7G, S7V, S7D, E9W, E9D, E9E, M16E, M16N, M16D, M16S, M16Q, M16T, M16A, M16L, M16H, M16F, M16I, S18C, S18Y, S18M, S18L, S18Q, S18G, S18P, S18A, S18W, S18H, S18K, S18I, S18V, S19C, S19V, S19L, S19F, S19K, S19E, S19D, S19G, S19N, S19A, S19M, S19P, S19Y, S19R, S19T, S19Q, S20G, S20M, S20L, S20V, S20H, S20W, S20A, S20C, S20Q, S20D, S20F, S20N, S20R, E21N, E21W, E21G, E21Q, E21L, E21D, E21A, E21P, E21T, E21S, E21Y, E21V, E21F, E21M, E22C, E22H, E22R, E22L, E22K, E22S, E22G, E22M, E22V, E22Q, E22A, E22Y, E22W, E22D, E22T, F23Q, F23A, F23D, F23W, F23K, F23T, F23V, F23M, F23N, F23P, F23H, F23E, F23C, F23R, F23Y, S24L, S24W, S24H, S24V, S24P, S24I, S24F, S24K, S24Y, S24D, S24C, S24N, S24G, S24A, S26F, S26H, S26V, S26Q, S26Y, S26W, S28K, S28Y, S28C, S28M, S28L, S28H, S28T, S28Q, V31L, V31T, V31I, V31Q, V31K, A34L, A34E, L67A, L67T, L67M, L67V, L67C, L67H, L67E, L67Y, G73H, G73N, G73K, G73F, G73V, G73D, G73S, G73W, G73L, A76L, A76R, A76E, A76I, A76V, D77N, D77Q, D77Y, D77L, D77T, P88A, P88E, P88N, P88H, P88D, P88L, N91D, N91R, N91A, N91L, N91H, N91V, Y141I, Y141M, Y141Q, Y141S, Y141E, Y141W, Y141V, Y141F, Y141A, Y141C, Y141K, Y141L, Y141H, Y141R, N145C, N145M, N145A, N145Q, N145I, N145F, N145G, N145D, N145E, N145V, N145H, N145W, N145Y, N145L, N145R, N145S, P146V, P146T, P146W, P146C, P146Q, P146L, P146Y, P146K, P146N, P146F, P146E, P148M, P148A, P148V, P148F, P148T, P148C, P148Q, P148H, Y150W, Y150A, Y150F, Y150H, Y150S, Y150V, Y150C, Y150M, Y150N, Y150D, Y150E, Y150Q, Y150K, H157Y, H157F, H157T, H157S, H157W, A162L, A162V, A162C, A162K, A162T, A162G, A162M, A162S, A162I, A162Y, A162Q, A179T, A179K, A179S, A179V, A179R, L182V, L182I, L182Q, L182T, L182W, L182R, L182S, T189C, T189N, T189L, T189K, T189Q, T189V, T189A, T189W, T189Y, T189G, T189F, T189S, T189H, L192V, L192C, L192H, L192M, L192I, S193P, S193T, S193R, S193K, S193G, S193D, S193N, S193F, S193H, S193Q, S193Y, V196L, V196S, V196W, V196A, V196F, V196M, V196I, S198G, S198R, S198A, S198K, T200C, T200I, T200M, T200L, T200N, T200W, T200V, T200Q, T200Y, T200H, T200R, S202A, S202P, L210H, L210A, F212Y, F212N, F212M, F212C, F212A, N218V, N218R, N218T, N218C, N218G, N218I, N218P, N218D, N218E, A248S, A248L, A248H, A248C, A248N, A248I, A248Q, A248Y, A248M, A248D, L263V, L263A, L263M, L263R, L263D, Q270V, Q270K, Q270A, Q270C, Q270P, Q270L, Q270I, Q270E, Q270G, Q270Y, Q270N, Q270T, Q270W, Q270H, S294R, S294N, S294G, S294T, S294C, T297C, T297P, T297V, T297M, T297L, T297D, E304D, E304H, E304S, E304Q, E304C, S308R, S308G, L310R, L310I, L310V, L333M, L333W, L333F, Q336Y, Q336N, Q336M, Q336A, Q336T, Q336L, Q336I, Q336G, Q336F, Q336E, Q336V, Q336C, Q336H, A354V, A354W, A354D, A354C, A354R, A354E, A354K, A354H, A354G, C357Q, C357H, C357W, C357N, C357I, C357V, C357M, C357R, C357F, C357D, L358A, L358F, L358E, L358R, L358Q, L358V, L358H, L358C, L358M, L358Y, L358K, L358N, L358I, D359N, D359A, D359L, D359H, D359R, D359S, D359Q, D359E, D359M, L377V, L377I, V423N, V423P, V423T, V423F, V423H, V423C, V423S, V423G, V423A, V423R, V423L, P426L, P426K, P426Y, P426F, P426T, P426W, P426V, P426C, P426S, P426Q, P426H, P426N, K428R, K428Q, K428N, K428T, K428F, S434K, S434T, S438Q, S438A, S438M, T447S, T447A, T447C, T447Q, T447N, T447G, L450M, L450V, L450A, L450I, L450E, A462M, A462T, A462Y, A462F, A462K, A462R, A462Q, A462H, A462E, A462N, A462C, V467T, V467C, V467A, V467K, I469V, I469N, I472V, I472L, I472W, I472M, I472F, L476I, L476V, L476N, L476F, L476M, L476C, L476Q, P488E, P488H, P488K, P488Q, P488F, P488M, P488L, P488N, P488D, Q498V, Q498L, Q498G, Q498H, Q498T, Q498C, Q498E, Q498M, L502I, L502M, L502V, L502G, L502F, E517M, E517V, E517A, E517K, E517L, E517G, E517S, E517I, P520W, P520R, P520M, P520F, P520Q, P520V, P520G, P520D, P520K, P520Y, P520E, P520L, P520T, S521A, S521H, S521C, S521V, S521W, S521T, S521K, S521F, S521G, N523W, N523A, N523G, N523S, N523P, N523M, N523Q, N523L, N523K, N523D, N523H, N523F, N523C, I533M, I533V, I533T, I533S, I533F, I533G, I533E, D534E, D534Q, D534L, D534R, D534V, D534C, D534M, D534N, D534A, D534G, D534F, D534T, D534H, D534K, D534S, F576L, F576K, F576V, F576D, F576W, F576M, F576C, F576R, F576Q, F576A, F576Y, F576N, F576G, F576I, F576E, K577L, K577G, K577D, K577R, K577H, K577Y, K577I, K577E, K577V, K577N, I582V, I582K, I582R, I582M, I582G, I582N, I582E, I582A, I582Q, Y583L, Y583C, Y583F, Y583D, Y583Q, L587F, L587D, L587R, L587I, L587P, L587N, L587E, L587S, L587Y, L587M, L587Q, L587G, L587W, L587K or L587T.

An advantageous piggyBac-like transposon for modifying the genome of a mammalian cell is a *Bombyx* transposon which comprises an ITR with the sequence of SEQ ID NO: 1010, a heterologous polynucleotide to be transposed and a second ITR with the sequence of SEQ ID NO: 1011. The transposon may be further be flanked by a copy of the tetranucleotide 5'-TTAA-3' on each side, immediately adjacent to the ITRs and distal to the heterologous polynucleotide. The transposon may further comprise a sequence immediately adjacent to the ITR and proximal to the heterologous polynucleotide that is at least 95% identical to SEQ ID NO: 1008 on one side of the heterologous polynucleotide, preferably the left side, and a sequence immediately adjacent to the ITR and proximal to the heterologous polynucleotide that is at least 95% identical to SEQ ID NO: 1009 on the other side of the heterologous polynucleotide, preferably the right side. This transposon may be transposed by a corresponding *Bombyx* transposase comprising a sequence at least 90% identical to SEQ ID NO: 1082, for example any of SEQ ID NOs: 1082-1104. Preferably the transposase is a hyperactive variant of a naturally occurring transposase. Preferably the hyperactive variant transposase comprises one or more of the following amino acid changes, relative to the sequence of SEQ ID NO: 1082: Q85E, Q85M, Q85K, Q85H, Q85N, Q85T, Q85F, Q85L, Q92E, Q92A, Q92P, Q92N, Q92I, Q92Y, Q92H, Q92F, Q92R, Q92D, Q92M, Q92W, Q92C, Q92G, Q92L, Q92V, Q92T, V93P, V93K, V93M, V93F, V93W, V93L, V93A, V93I, V93Q, P96A, P96T, P96M, P96R, P96G, P96V, P96E, P96Q, P96C, F97Q, F97K, F97H, F97T, F97C, F97W, F97V, F97E, F97P, F97D, F97A, F97R, F97G, F97N, F97Y, H165E, H165G, H165Q, H165T, H165M, H165V, H165L, H165N, H165D, H165K, H165W, H165A, E178S, E178H, E178Y, E178F, E178C, E178A, E178Q, E178G, E178V, E178D, E178L, E178P, E178W, C189D, C189Y, C189I, C189W, C189T, C189K, C189M, C189F, C189P, C189Q, C189V, A196G, L200I, L200F, L200C, L200M, L200Y, A201Q, A201L, A201M, L203V, L203D, L203G, L203E, L203C, L203T, L203M, L203A, L203Y, N207G, N207A, L211G, L211M, L211C, L211T, L211V, L211A, W215Y, T217V, T217A, T217I, T217P, T217C, T217Q, T217M, T217F, T217D, T217K, G219S, G219A, G219C, G219H, G219Q, Q235C, Q235N, Q235H, Q235G, Q235W, Q235Y, Q235A, Q235T, Q235E, Q235M, Q235F, Q238C, Q238M, Q238H, Q238V, Q238L, Q238T, Q238I, R242Q, K246I, K253V, M258V, F261L, S263K, C271S, N303C, N303R, N303G, N303A, N303D, N303S, N303H, N303E, N303R, N303K, N303L, N303Q, I312F, I312C, I312A, I312L, I312T, I312V, I312G, I312M, F321H, F321R, F321N, F321Y, F321W, F321D, F321G, F321E, F321M, F321K, F321A, F321Q, V323I, V323L, V323T, V323M, V323A, V324N, V324A, V324C, V324I, V324L, V324T, V324K, V324Y, V324H, V324F, V324S, V324Q, V324M, V324G, A330K, A330V, A330P, A330S, A330C, A330T, A330L, Q333P, Q333T, Q333M, Q333H, Q333S, P337W, P337E, P337H, P337I, P337A, P337M, P337N, P337D, P337K, P337Q, P337G, P337S, P337C, P337L, P337V, F368Y, L373C, L373V, L373I, L373S, L373T, V389I, V389M, V389T, V389L, V389A, R394H, R394K, R394T, R394P, R394M, R394A, Q395P, Q395F, Q395E, Q395C, Q395V, Q395A, Q395H, Q395S, Q395Y, S399N, S399E, S399K, S399H, S399D, S399Y, S399G, S399Q, S399R, S399T, S399A, S399V, S399M, R402Y, R402K, R402D, R402F, R402G, R402N, R402E, R402M, R402S, R402Q, R402T, R402C, R402L, R402V, T403W, T403A, T403V, T403F, T403L, T403Y, T403N, T403G, T403C, T403I, T403S, T403M, T403Q, T403K, T403E, D404I, D404S, D404E, D404N, D404H, D404C, D404M, D404G, D404A, D404Q, D404L, D404P, D404V, D404W, D404F, N408F, N408I, N408A, N408E, N408M, N408S, N408D, N408Y, N408H, N408C, N408Q, N408V, N408W, N408L, N408P, N408K, S409H, S409Y, S409N, S409I, S409D, S409F, S409T, S409C, S409Q, N441F, N441R, N441M, N441G, N441C, N441D, N441L, N441A, N441V, N441W, G448W, G448Y, G448H, G448C, G448T, G448V, G448N, G448Q, E449A, E449P, E449T, E449L, E449H, E449G, E449C, E449I, V469T, V469A, V469H, V469C, V469L, L472K, L472Q, L472M, C473G, C473Q, C473T, C473I, C473M, R484H, R484K, T507R, T507D, T507S, T507G, T507K, T507I, T507M, T507E, T507C, T507L, T507V, G523Q, G523T, G523A, G523M, G523S, G523C, G523I, G523L, I527M, I527V, Y528N, Y528W, Y528M, Y528Q, Y528K, Y528V, Y528I, Y528G, Y528D, Y528A, Y528E, Y528R, Y543C, Y543W, Y543I, Y543M, Y543Q, Y543A, Y543R, Y543H, E549K, E549C, E549I, E549Q, E549A, E549H, E549C, E549M, E549S, E549F, E549L, K550R, K550M, K550Q, S556Q, S556V, S556I, P557W, P557T, P557S, P557A, P557Q, P557K, P557D, P557G, P557N, P557L, P557V, H559K, H559S, H559C, H559I, H559W, V560F, V560P, V560I, V560H, V560Y, V560K, N561P, N561Q, N561G, N561A, V562Y, V562I, V562S, V562M, V567I, V567H, V567N, S583M, E601V, E601F, E601Q, E601W, E605R, E605W, E605K, E605M, E605P, E605Y, E605C, E605H, E605A, E605Q, E605S, E605V, E605I, E605G, D607V, D607Y, D607C, D607N, D607W, D607T, D607A, D607H, D607Q, D607E, D607L, D607K, D607G, S609R, S609W, S609H, S609V, S609Q, S609G, S609T, S609K, S609N, S609Y, L610T, L610I, L610K, L610G, L610A, L610W, L610D, L610Q, L610S, L610F or L610N.

An advantageous piggyBac-like transposon for modifying the genome of a mammalian cell is a piggyBat transposon which comprises an ITR with the sequence of SEQ ID NO: 1016, a heterologous polynucleotide to be transposed and a second ITR with the sequence of SEQ ID NO: 1017. The transposon may further be flanked by a copy of the tetra-nucleotide 5'-TTAA-3' on each side, immediately adjacent to the ITRs and distal to the heterologous polynucleotide. The transposon may further comprise a sequence immediately adjacent to the ITR and proximal to the heterologous polynucleotide that is at least 95% identical to SEQ ID NO: 1018 on one side of the heterologous polynucleotide, preferably the left side, and a sequence immediately adjacent to the ITR and proximal to the heterologous polynucleotide that is at least 95% identical to SEQ ID NO: 1019 on the other side of the heterologous polynucleotide, preferably the right side. This transposon may be transposed by a corresponding piggyBat transposase comprising a sequence at least 90% identical to SEQ ID NO: 1046. Preferably the transposase is a hyperactive variant of a naturally occurring transposase. Preferably the hyperactive variant transposase comprises one or more of the following amino acid changes, relative to the sequence of SEQ ID NO: 1046: A14V, D475G, P491Q, A561T, T546T, T300A, T294A, A520T, G239S, S5P, S8F, S54N, D9N, D9G, I345V. M481V, EI1G, K130T, G9G, R427H, S8P, S36G, D1OG, S36G.

An advantageous piggyBac-like transposon for modifying the genome of a mammalian cell is a piggyBac transposon which comprises an ITR with the sequence of SEQ ID NO: 1014, a heterologous polynucleotide to be transposed and a second ITR with the sequence of SEQ ID NO: 1015. The transposon may further be flanked by a copy of the tetra-nucleotide 5'-TTAA-3' on each side, immediately adjacent to the ITRs and distal to the heterologous polynucleotide. The transposon may further comprise a sequence immediately adjacent to the ITR and proximal to the heterologous polynucleotide that is at least 95% identical to SEQ ID NO: 1012 on one side of the heterologous polynucleotide, preferably the left side, and a sequence immediately adjacent to the ITR and proximal to the heterologous polynucleotide that is at least 95% identical to SEQ ID NO: 1013 on the other side of the heterologous polynucleotide preferably the right side. This transposon may be transposed by a corresponding piggyBac transposase comprising a sequence at least 90% identical to SEQ ID NO: 1047. Preferably the transposase is a hyperactive variant of a naturally occurring transposase. Preferably the hyperactive variant transposase comprises one or more of the following amino acid changes, relative to the sequence of SEQ ID NO: 1047: G2C, Q40R, I30V, G1655, T43A, S61R, S103P, S103T, M194V, R281G, M282V, G316E, I426V, Q497L, N505D, Q573L, S509G, N570S, N538K, Q591P, Q591R, F594L, M194V, I30V, S103P, G165S, M282V, S509G, N538K, N571S, C41T, A1424G, C1472A, G1681A, T150C, A351G, A279G, T1638C, A898G, A880G, G1558A, A687G, G715A, T13C, C23T, G161A, G25A, T1050C, A1356G, A26G, A1033G, A1441G, A32G, A389C, A32G, A389C, A32G, T1572A, G456A, T1641C, Tl 155C, G1280A, T22C, A106G, A29G, C137T, A14V, D475G, P491Q, A561T, T546T, T300A, T294A, A520T, G239S, SSP, SBF, S54N, D9N, D9G, 1345V, M481V, E11G, K130T, G9G, R427H, S8P, S36G, D1OG, S36G, A51T, C153A, C277T, G201A, G202A, T236A, A103T, A104C, T140C, G138T, T118A, C74T, A179C, S3N, I30V, A46S, A46T, I82W, S103P, R119P, C125A, C125L, G165S, Y177K, Y177H, F180L, F180I, F180V, M185L, A187G, F200W, V207P, V209F, M226F, L235R, V240K, F241L, P243K, N258S, M282Q, L296W, L296Y, L296F, M298V, M298A, M298L, P311V, P311I, R315K, T319G, Y327R, Y328V, C340G, C340L, D421H, V436I, M456Y, L470F, S486K, M503I, M503L, V552K, A570T, Q591P, Q591R, R65A, R65E, R95A, R95E, R97A, R97E, R135A, R135E, R161A, R161E, R192A, R192E, R208A, R208E, K176A, K176E, K195A, K195E, S171E, M14V, D270N, I30V, G165S, M282L, M282I, M282V or M282A.

An advantageous piggyBac-like transposon for modifying the genome of a cultured mammalian cell is an *Amyelois* transposon comprising an ITR with the sequence of SEQ ID NO: 1022, a heterologous polynucleotide and a second ITR with the sequence of SEQ ID NO: 1023. The transposon may further be flanked by a copy of the tetranucleotide 5'-TTAA-3' on each side, immediately adjacent to the ITRs and distal to the heterologous polynucleotide. The transposon may further comprise a sequence that is at least 95% identical to SEQ ID NO: 1020 on one side of the heterologous polynucleotide, and a sequence that is at least 95% identical to SEQ ID NO: 1021 on the other side of the heterologous polynucleotide. This transposon may be transposed by a corresponding Amyelois transposase comprising a sequence at least 90% identical to SEQ ID NO: 1105. Preferably the transposase is a hyperactive variant of a naturally occurring transposase. Preferably the hyperactive variant transposase comprises one or more of the following amino acid changes, relative to the sequence of SEQ ID NO: 1105: P65E, P65D, R95S, R95T, V100I, V100L, V100M, L115D, L115E, E116P, H121Q, H121N, K139E, K139D, T159N, T159Q, V166F, V166Y, V166W, G179N, G179Q, W187F, W187Y, P198R, P198K, L203R, L203K, I209L, I209V, I209M, N211R, N211K, E238D, L273I, L273V, L273M, D304K, D304R, I323L, I323M, I323V, Q329G, Q329R, Q329K, T345L, T345I, T345V, T345M, K362R, T366R, T366K, T380S, L408M, L408I, L408V, E413S, E413T, S416E, S416D, I426M, I426L, I426V, S435G, L458M, L458I, L458V, A472S, A472T, V475I, V475L, V475M, N483K, N483R, I491M, I491V, I491L, A529P, K540R, S560K, S560R, T562K, T562R, S563K, S563R.

An advantageous piggyBac-like transposon for modifying the genome of a cultured mammalian cell is a Heliothis transposon comprising an ITR with the sequence of SEQ ID NO: 1026, a heterologous polynucleotide and a second ITR with the sequence of SEQ ID NO: 1027. The transposon may further be flanked by a copy of the tetranucleotide 5'-TTAA-3' on each side, immediately adjacent to the ITRs and distal to the heterologous polynucleotide. The transposon may further comprise a sequence that is at least 95% identical to SEQ ID NO: 1024 on one side of the heterologous polynucleotide, and a sequence that is at least 95% identical to SEQ ID NO: 1025 on the other side of the heterologous polynucleotide. This transposon may be transposed by a corresponding *Heliothis* transposase comprising a sequence at least 90% identical to SEQ ID NO: 1106. Preferably the transposase is a hyperactive variant of a naturally occurring transposase. Preferably the hyperactive variant transposase comprises one or more of the following amino acid changes, relative to the sequence of SEQ ID NO: 1106: S41V, 541I, S41L, L43S, L43T, V81E, V81D, D83S, D83T, V85L, V85I, V85M, P125S, P125T, Q126S, Q126T, Q131R, Q131K, Q131T, Q131S, S136V, S136I, S136L, S136M, E140C, E140A, N151Q, K169E, K169D, N212S, I239L, I239V, I239M, H241N, H241Q, T268D, T268E, T297C, M300R, M300K, M305N, M305Q, L312I, C316A, C316M, L321V, L321M, N322T, N322S, P351G, H357R, H357K, H357D, H357E, K360Q, K360N, E379P, K397S, K397T, Y421F, Y421W, V450I, V450L, V450M, Y495F, Y495W, A447N, A447D, A449S, A449V, K476L, V492A, I500M, L585K and T595K.

An advantageous piggyBac-like transposon for modifying the genome of a cultured mammalian cell is an Oryzias transposon comprising an ITR with the sequence of SEQ ID NO: 1030, a heterologous polynucleotide and a second ITR with the sequence of SEQ ID NO: 1031. The transposon may further be flanked by a copy of the tetranucleotide 5'-TTAA-3' on each side, immediately adjacent to the ITRs and distal to the heterologous polynucleotide. The transposon may further comprise a sequence that is at least 95% identical to SEQ ID NO: 1028 on one side of the heterologous polynucleotide, and a sequence that is at least 95% identical to SEQ ID NO: 1029 on the other side of the heterologous polynucleotide. This transposon may be transposed by a corresponding Oryzias transposase comprising a sequence at least 90% identical to SEQ ID NO: 1107. Preferably the transposase is a hyperactive variant of a naturally occurring transposase. Preferably the hyperactive variant transposase comprises one or more of the following amino acid changes, relative to the sequence of SEQ ID NO: 1107: E22D, A124C, Q131D, Q131E, L138V, L138I, L138M, D160E, Y164F, Y164W, I167L, I167V, I167M, T202R, T202K, I206L, I206V, I206M, I210L, I210V, I210M, N214D, N214E, V253I, V253L, V253M, V258L, V258I, V258M, A284L, A284I, A284M, A284V, V386I, V386M, V386L, M400L, M400I, M400V, S408E, S408D, L409I, L409V, L409M, V458L, V458M, V458I, V467I, V467M, V467L, L468I, L468V, L468M, A514R, A514K, V515I, V515M, V515L, R548K, D549K, D549R, D550R, D550K, S551K and S551R An advantageous piggyBac-like transposon for modifying the genome of a cultured mammalian cell is an Agrotis transposon comprising an ITR with the sequence of SEQ ID NO: 1036, a heterologous polynucleotide and a second ITR with the sequence of SEQ ID NO: 1037. The transposon may further be flanked by a copy of the tetranucleotide 5'-TTAA-3' on each side, immediately adjacent to the ITRs and distal to the heterologous polynucleotide. The transposon may further comprise a sequence that is at least 95% identical to SEQ ID NO: 1034 on one side of the heterologous polynucleotide, and a sequence that is at least 95% identical to SEQ ID NO: 1035 on the other side of the heterologous polynucleotide. This transposon may be transposed by a corresponding Agrotis transposase comprising a sequence at least 90% identical to SEQ ID NO: 1108. Preferably the transposase is a hyperactive variant of a naturally occurring transposase.

An advantageous piggyBac-like transposon for modifying the genome of a cultured mammalian cell is a *Helicoverpa* transposon comprising an ITR with the sequence of SEQ ID NO: 1040, a heterologous polynucleotide and a second ITR with the sequence of SEQ ID NO: 1041. The transposon may further be flanked by a copy of the tetranucleotide 5'-TTAA-3' on each side, immediately adjacent to the ITRs and distal to the heterologous polynucleotide. The transposon may further comprise a sequence that is at least 95% identical to SEQ ID NO: 1038 on one side of the heterologous polynucleotide, and a sequence that is at least 95% identical to SEQ ID NO: 1039 on the other side of the heterologous polynucleotide. This transposon may be transposed by a corresponding *Helicoverpa* transposase comprising a sequence at least 90% identical to SEQ ID NO: 1109.

Preferably the transposase is a hyperactive variant of a naturally occurring transposase.

An advantageous Mariner transposon for modifying the genome of a mammalian cell is a Sleeping Beauty transposon, for example one that comprises an ITR with the sequence of SEQ ID NO: 1044, a heterologous polynucleotide and a second ITR with the sequence of SEQ ID NO: 1045. An advantageous Mariner transposon for modifying the genome of a mammalian cell comprises a first transposon end with at least 90% sequence identity to SEQ ID NO: 1042, and a second transposon end with at least 90% sequence identity to SEQ ID NO: 1043. This transposon may be transposed by a corresponding Sleeping Beauty transposase comprising a sequence at least 90% identical to SEQ ID NO: 1048, including hyperactive variants thereof.

An advantageous hAT transposon for modifying the genome of a mammalian cell is a TcBuster transposon, for example one that comprises an ITR with the sequence of SEQ ID NO: 1112, a heterologous polynucleotide and a second ITR with the sequence of SEQ ID NO: 1113. An advantageous hAT transposon for modifying the genome of a mammalian cell comprises a first transposon end with at least 90% sequence identity to SEQ ID NO: 1110, and a second transposon end with at least 90% sequence identity to SEQ ID NO: 1111. This transposon may be transposed by a corresponding TcBuster transposase comprising a sequence at least 90% identical to SEQ ID NO: 1114, including hyperactive variants thereof.

A transposase protein can be introduced into a cell as a protein or as a nucleic acid encoding the transposase, for example as a ribonucleic acid, including mRNA or any polynucleotide recognized by the translational machinery of a cell; as DNA, e.g. as extrachromosomal DNA including episomal DNA; as plasmid DNA, or as viral nucleic acid. Furthermore, the nucleic acid encoding the transposase protein can be transfected into a cell as a nucleic acid vector such as a plasmid, or as a gene expression vector, including a viral vector. The nucleic acid can be circular or linear. DNA encoding the transposase protein can be stably inserted into the genome of the cell or into a vector for constitutive or inducible expression. Where the transposase protein is transfected into the cell or inserted into the vector as DNA, the transposase encoding sequence is preferably operably linked to a heterologous promoter. There are a variety of promoters that could be used including constitutive promoters, tissue-specific promoters, inducible promoters, species-specific promoters, celltype specific promoters and the like. All DNA or RNA sequences encoding transposase proteins are expressly contemplated. Alternatively, the transposase may be introduced into the cell directly as protein, for example using cell-penetrating peptides (e.g. as described in Ramsey and Flynn, 2015. Pharmacol. Ther. 154: 78-86 "Cell-penetrating peptides transport therapeutics into cells"); using small molecules including salt plus propane-betaine (e.g. as described in Astolfo et. al., 2015. Cell 161: 674-690); or electroporation (e.g. as described in Morgan and Day, 1995. Methods in Molecular Biology 48: 63-71 "The introduction of proteins into mammalian cells by electroporation").

5.2.3 Promoter Elements

Gene transfer systems for expression of polypeptides in cultured mammalian cells comprise a polynucleotide to be transferred to a host cell. The polynucleotide comprises a promoter that is active in the cultured mammalian cell, operably linked to a heterologous sequence to be expressed. Advantageous gene transfer polynucleotides for the expression of amiRNAs in mammalian cells comprise a Pol II promoter such as an EF1a promoter from any mammalian or avian species including human, rat, mice, chicken and Chinese hamster, (for example a sequence selected from SEQ ID NOS: 894-915); a promoter from the immediate early genes 1, 2 or 3 of cytomegalovirus (CMV) from either human, primate or rodent cells (for example a sequence selected from SEQ ID NOS: 916-927); a promoter for eukaryotic elongation factor 2 (EEF2) from any mammalian or avian species including human, rat, mice, chicken and Chinese hamster, (for example a sequence selected from SEQ ID NOS: 928-938); a Glyceraldehyde 3-phosphate dehydrogenase (GAPDH) promoter from any mammalian or yeast species (for example a sequence selected from SEQ ID NOS: 949-965), an actin promoter from any mammalian or avian species including human, rat, mice, chicken and Chinese hamster (for example a sequence selected from SEQ ID NOS: 939-948); a PGK promoter from any mammalian or avian species including human, rat, mice, chicken and Chinese hamster (for example a sequence selected from SEQ ID NOS: 966-974 or 1188), or a ubiquitin promoter (for example SEQ ID NO: 975), or a viral promoter such as an HSV-TK promoter or an SV40 promoter (for example a sequence selected from SEQ ID NOS: 976-982) operably linked to a multi-hairpin amiRNA sequence. Alternatively, a multi-hairpin amiRNA sequence may be operably linked to a Pol III promoter such as a U6 promoter (for example a sequence selected from SEQ ID NOs: 987-991) or an H1 promoter (for example SEQ ID NO: 992).

5.2.4 Micro RNA Elements

Small inhibitory RNAs (siRNAs) have been used to reduce the activity of certain genes within mammalian culture cells through RNA interference. An siRNA can be expressed in a cell from a nucleic acid encoding a short hairpin RNA (shRNA) operably linked to a promoter naturally transcribed by RNA polymerase III (a "Pol III promoter"). Naturally occurring shRNAs may also be expressed from nucleic acids operably linked to a promoter naturally transcribed by RNA polymerase II (a "Pol II promoter"). The Pol II promoter is typically responsible for transcription of most protein-encoding genes. The products of natural Pol II-expressible shRNA genes are referred to as microRNAs (miRNAs).

Expression of targeted shRNAs within mammalian cells can be accomplished by engineering natural miRNAs, replacing the natural guide strand sequence with a sequence complementary to a target mRNA whose expression is to be reduced, thereby creating an artificial miRNA (amiRNA) as described for the miR-30 micro RNA (Zeng et. al., 2002. Both Natural and Designed Micro RNAs Technique Can Inhibit the Expression of Cognate mRNAs When Expressed in Human Cells. Molecular Cell: 9, 1327-1333).

The reduction in gene expression in mammalian cells that can be achieved through RNA interference using amiRNA is variable. Success is often limited because of the limited efficacy of any single inhibitory RNA. Strategies that have been described to improve the efficacy of RNA interference include the incorporation of mismatches in the intramolecular RNA duplex (Wu et. al., 2011. Improved siRNA/shRNA Functionality by Mismatched Duplex. PLoS ONE 6(12): e28580. doi:10.1371/journal.pone.0028580; Myburgh et. al., 2014. Optimization of Critical Hairpin Features Allows miRNA-based Gene Knockdown Upon Single-copy Transduction. Molecular Therapy-Nucleic Acids 3, e207; doi:

10.1038/mtna.2014.58), insertion of spacer regions within the amiRNA genes, between the Pol II promoter and the sequences of the amiRNA hairpins (Rousset et. al., 2019. Optimizing Synthetic miRNA Minigene Architecture for Efficient miRNA Hairpin Concatenation and Multi-target Gene Knockdown. Molecular Therapy-Nucleic Acids 14, 351-363.), and the concatenation of amiRNA hairpins within an amiRNA gene (Sun et al., 2006. Multi-miRNA hairpin method that improves gene knockdown efficiency and provides linked multi-gene knockdown. BioTechniques 41:59-63 doi 10.2144/000112203).

Although amiRNA genes comprising multiple copies of the same hairpin have been shown to be more effective than amiRNA genes with only a single copy of the hairpin, even with three identical hairpins in a single lentiviral vector, it is difficult to reduce expression of the target gene to less than 10% of normal levels (Sun et al. 2006 ibid, Rousset et. al., 2019 ibid). The other application for genes comprising multiple amiRNA hairpins has been for simultaneous inhibition of multiple genes (Hu et. al., 2009. Construction of an Artificial MicroRNA Expression Vector for Simultaneous Inhibition of Multiple Genes in Mammalian Cells. Int. J. Mol. Sci. 10, 2158-2168; Choi et al, 2015. Mol. Ther. 23, 310-320. "Multiplexing Seven miRNA-Based shRNAs to Suppress HIV Replication").

Instead of targeting one sequence in a target mRNA with multiple identical inhibitory RNAs derived from multiple identical hairpins, we have designed amiRNA genes comprising multiple different hairpins, each for the expression of a different inhibitory RNA guide strand complementary to different regions within the same target mRNA. Because the guide strand sequences derived from each hairpin target different areas of the gene, they are essentially independent. Furthermore, the processing of hairpins to produce RISC-associated guide strands is improved if multiple hairpins are contained within the same RNA transcript. In addition, the use of multiple independent guide strands reduces the risk of unwanted off-target effects, since it is not necessary to express any individual guide strand at extremely high levels. It is thus advantageous to use a polynucleotide comprising two or three or four or five or more hairpins which will be expressed within a mammalian cell to produce two or three or four or five or more different inhibitory RNA guide strands, each of which is complementary to a different sequence within the same target mRNA. When more than one hairpin for the expression of inhibitory RNA guide strands are operably linked to the same promoter we refer to them as a multi-hairpin amiRNA gene. Preferably, when integrated into the genome of a mammalian cell, the multi-hairpin amiRNA gene reduces the expression of the target gene to a level lower than the level of expression of the target gene in a mammalian cell whose genome comprises an amiRNA gene comprising a hairpin for expression of a single inhibitory RNA guide strand. Preferably, when integrated into the genomes of a population of mammalian cells, the multi-hairpin amiRNA gene reduces the average expression of the target gene within the population to a level lower than the level of expression of the target gene in a population of mammalian cells whose genomes comprises an amiRNA gene comprising a hairpin for expression of a single inhibitory RNA guide strand. Preferably, when integrated into the genomes of a population of mammalian cells, the multi-hairpin amiRNA gene reduces the expression of the target gene to less than 50% of the natural level in a greater fraction of the population than the fraction of the population in which expression is reduced to less than 50% in a population of mammalian cells whose genomes comprises an amiRNA gene comprising a hairpin for expression of a single inhibitory RNA guide strand. Preferably, when integrated into the genomes of a population of mammalian cells, the multi-hairpin amiRNA gene reduces the expression of the target gene to less than 40% of the natural level in a greater fraction of the population than the fraction of the population in which expression is reduced to less than 40% in a population of mammalian cells whose genomes comprises an amiRNA gene comprising a hairpin for expression of a single inhibitory RNA guide strand. Preferably, when integrated into the genomes of a population of mammalian cells, the multi-hairpin amiRNA gene reduces the expression of the target gene to less than 30% of the natural level in a greater fraction of the population than the fraction of the population in which expression is reduced to less than 30% in a population of mammalian cells whose genomes comprises an amiRNA gene comprising a hairpin for expression of a single inhibitory RNA guide strand. Preferably, when integrated into the genomes of a population of mammalian cells, the multi-hairpin amiRNA gene reduces the expression of the target gene to less than 20% of the natural level in a greater fraction of the population than the fraction of the population in which expression is reduced to less than 20% in a population of mammalian cells whose genomes comprises an amiRNA gene comprising a hairpin for expression of a single inhibitory RNA guide strand. Preferably, when integrated into the genomes of a population of mammalian cells, the multi-hairpin amiRNA gene reduces the expression of the target gene to less than 10% of the natural level in a greater fraction of the population than the fraction of the population in which expression is reduced to less than 10% in a population of mammalian cells whose genomes comprises an amiRNA gene comprising a hairpin for expression of a single inhibitory RNA guide strand. Preferably, when integrated into the genomes of a population of mammalian cells, the multi-hairpin amiRNA gene reduces the expression of the target gene to less than 5% of the natural level in a greater fraction of the population than the fraction of the population in which expression is reduced to less than 5% in a population of cultured mammalian cells whose genomes comprises an amiRNA gene comprising a hairpin for expression of a single inhibitory RNA guide strand.

Preferably, when integrated into the genome of a mammalian cell, the multi-hairpin amiRNA gene reduces the expression of the target gene to less than 50% or 40% or 30% or 20% or 10% or 5% or 2% or 1% of the natural expression level of the target gene. Such reduction of expression may be detected directly as a reduction in mRNA levels or of protein levels, but it may also be detected as a corresponding decrease in the function or activity for which the target gene is responsible. For example, if the product of the target gene is an intracellular protein, preferably, when integrated into the genome of a mammalian cell, the multi-hairpin amiRNA gene reduces the activity of the product of the target gene within the cell to less than 50% or 40% or 30% or 20% or 10% or 5% or 2% or 1% of the natural activity of the product of the target gene within the cell. If the product of the target gene is an extracellular protein, preferably, when integrated into the genome of a mammalian cell, the multi-hairpin amiRNA gene reduces the activity of the product of the target gene secreted from the cell to less than 50% or 40% or 30% or 20% or 10% or 5% or 2% or 1% of the natural activity of the product of the target gene secreted from the cell. If the product of the target gene is a transmembrane protein such as a receptor protein with a signaling function, preferably, when integrated into the genome of a mammalian cell, the multi-hairpin amiRNA gene reduces signal transduction by the product of the target gene to less than 50% or 40% or 30% or 20% or 10% or 5% or 2% or 1% of the natural signal transduction by the product of the target gene. If normal expression of the target gene results in modification of a product made by the mammalian cell, when the multi-hairpin amiRNA gene is integrated into the genome of a mammalian cell, expression of the target gene is preferably reduced such that less than 50% or 40% or 30% or 20% or 10% or 5% or 2% or 1% of the product made by the mammalian cell is modified by the action of the target gene product. If normal expression of the target gene results in modification of a product made by the mammalian cell, when the multi-hairpin amiRNA gene is integrated into the genome of a mammalian cell, expression of the target gene is preferably reduced such that the extent of product modification resulting from the expression of the target gene is reduced to less than 50% or 40% or 30% or 20% or 10% or 5% or 2% or 1% of the extent to which the product would be modified in the absence of the multi-hairpin amiRNA gene. Product modifications include the proteolytic cleavage, or glycosylation or other post-translational modification of a protein produced by the mammalian cell.

The guide strand sequence of an amiRNA comprises 19 or 20 or 21 or 22 bases that are complementary to the mRNA of the target gene. The guide strand sequence may be complementary to any part of the mRNA, preferably it is complementary to the 3' UTR of the mRNA or the 5' UTR of the mRNA or the coding region of the mRNA. Preferably the 5' base of the guide strand sequence is a thymine (T). The passenger strand sequence of an amiRNA is complementary to the guide strand sequence. It is often advantageous for appropriate processing of an amiRNA if the passenger strand sequence is not perfectly complementary to the guide strand sequence. Processing is often improved if the passenger strand sequence is mismatched at the base complementary to the 5' base of the guide strand sequence. A general schematic of an exemplary amiRNA hairpin is shown in FIGS. 1A-B. Preferably the passenger strand sequence comprises a mismatch in complementarity with the guide strand sequence at the base corresponding to the 5' base of the guide strand sequence (base Ni in FIGS. 1A-B). If the 5' base of the guide strand sequence is an adenine (A) or thymine (T), the passenger strand sequence preferably comprises a cytosine (C) in the corresponding complementary position (base $N'_1$ in FIGS. 1A-B). If the 5' base of the guide strand sequence is a cytosine (C) or guanine (G), the passenger strand sequence preferably comprises an adenine (A) in the corresponding complementary position. One, two or three additional mismatches may be incorporated into the passenger strand sequence as mismatched bases, insertions or deletions. Most favorable mismatches are made in the passenger strand sequence that create mismatches at one or more of the corresponding positions complementary to positions 9, 10, 11, 12 or 13 in the guide strand sequence (bases $N_9$, $N_{10}$, $N_{11}$, $N_{12}$ and $N_{13}$ in FIGS. 1A-B). Most preferably, the passenger strand sequence comprises a mismatch at the base corresponding to position 12 in the guide strand sequence (base $N'_{12}$ in FIGS. 1A-B). The guide and the passenger strand sequences of an amiRNA are typically separated by an unstructured loop of between 5 and 35 nucleotides (bases L-Lz in FIGS. 1A-B). Preferably the loop comprises a sequence derived from a naturally occurring miRNA, for example a sequence selected from SEQ ID NO: 683-692.

A preferred gene transfer polynucleotide for the inhibition of a target gene ("the inhibitory polynucleotide") comprises a multi-hairpin amiRNA gene comprising at least two different amiRNA hairpin sequences whose guide strand sequences are different and are each complementary to a different sequence in the same target mRNA. The multi-hairpin amiRNA gene comprises a first (guide strand) sequence of at least 19 or 20 or 21 or 22 contiguous bases that are complementary to the target mRNA and a first (passenger strand) sequence of at least 19 or 20 or 21 or 22 bases that are at least 78% identical to the reverse complement of the first guide strand sequence (i.e. within 19 bases it comprises no more than 4 mismatches, including mutations, single base deletions or single base insertions, relative to the identical reverse complement of the first guide strand sequence). The first guide strand sequence and the first passenger strand sequence are separated by between 5 and 35 bases. The first guide strand sequence, the first passenger strand sequence and the sequence separating them are collectively the first hairpin. The multi-hairpin amiRNA gene further comprises a second (guide strand) sequence of at least 19 or 20 or 21 or 22 contiguous bases that are complementary to the target mRNA and a second (passenger strand) sequence of at least 19 or 20 or 21 or 22 bases that are at least 78% identical to the reverse complement of the second guide strand sequence (i.e. within 19 bases it comprises no more than 4 mismatches, including mutations, single base deletions or single base insertions, relative to the identical reverse complement of the second guide strand sequence). The second guide strand sequence and the second passenger strand sequence are separated by between 5 and 35 bases. The second guide strand sequence, the second passenger strand sequence and the sequence separating them are collectively the second hairpin. The first and second guide strand sequences are different from each other but complementary to the same target mRNA.

The multi-hairpin amiRNA gene may further comprise a third guide strand sequence of at least 19 or 20 or 21 or 22 bases that is complementary to the target mRNA and a third passenger strand sequence of at least 19 or 20 or 21 or 22 bases that is at least 78% identical to the reverse complement of the third guide strand sequence (i.e. within 19 bases it comprises no more than 4 mismatches, including mutations, single base deletions or single base insertions, relative to the identical reverse complement of the third guide strand sequence). The third guide strand sequence and the third passenger strand sequence are separated by between 5 and 35 bases. The third guide strand sequence, the third passenger strand sequence and the sequence separating them are collectively the third hairpin. The first and second and third guide strand sequences are each complementary to a different region of the same target mRNA.

The multi-hairpin amiRNA gene further comprises a promoter that is active in mammalian cells, preferably transcribable by RNA polymerase II or RNA polymerase III. Each hairpin is operably linked to the promoter. Preferably the promoter is heterologous to the hairpins. It the promoter is transcribed by RNA polymerase II, it is advantageous for the inhibitory polynucleotide further comprises a spacer polynucleotide that is operably linked to the promoter: the amiRNA hairpins may be placed to the 3' UTR of the spacer polynucleotide, or they may be placed into an intron that is transcribed by the Pol II promoter. The spacer polynucleotide may comprise an open reading frame encoding an expressible polypeptide, or it may comprise a sequence that does not encode an expressible polypeptide. Preferably the spacer polynucleotide comprises between 50 and 3,000 nucleotides, more preferably the spacer is between 100 and 1,500 nucleotides. Optionally the spacer comprises an open reading frame to be expressed in the mammalian cell, such as a chimeric antigen receptor or a selectable marker. Example spacer polynucleotide sequences are given as SEQ ID NO: 723-724.

Each hairpin may comprise sequences in addition to the guide and passenger strand sequences to enhance the stem-loop structure of the transcribed RNA, in order to increase the chance of processing and loading the guide strand into the RISC complex. A schematic of an exemplary multi-hairpin amiRNA gene is shown in FIGS. 2A-B. Short sequences (between 5 and 20 bases) may be added to the 5' and 3' of the guide-loop-passenger hairpin in order to stabilize it and improve processing of the RNA into the RISC complex. These are shown in FIGS. 2A-B as elements A and E stabilizing hairpin 1 and elements G and K stabilizing hairpin 2. For example a short sequence with SEQ ID NO: 697 may be added to the 5' side of the guide-loop-passenger hairpin sequence and a short sequence with SEQ ID NO: 698 may be added to the 3' side of the guide-loop-passenger hairpin sequence to enhance RNA hairpin formation. Alternative exemplary pairs of stem-stabilizing sequences that can be added to the 5' and 3' of the guide-loop-passenger strand sequence respectively to enhance RNA hairpin formation are SEQ ID NOs: 699 and 700, or SEQ ID NOs: 701 and 702, or SEQ ID NOs: 703 and 704, or SEQ ID NOs: 705 and 706, or SEQ ID NOs: 709 and 710, or SEQ ID NOs: 711 and 712, or SEQ ID NOs: 713 and 714, or a 5' additional stem with sequence 5'-GTAGCAC-3' and a 3' additional stem with sequence 5'-TACTGC-3'. These stem sequences are derived from the sequences flanking the guide-loop-passenger hairpin portion of the miRNA sequence in naturally occurring miRNAs. The corresponding sequences from other miRNAs may also be used. Although most of the exemplary sequences given herein have the guide strand sequence preceding the passenger strand sequence, the order may be 5'-guide-loop-passenger-3' or it may be 5'-passenger-loop-guide-3', as shown in FIGS. 1A-B. The sequence that is loaded into the RISC complex is not determined by the order in which they occur. It is intended that "guide-loop-passenger" be read as meaning a sequence comprising these three elements in either configuration 5'-guide-loop-passenger-3' or 5'-passenger-loop-guide-3'.

It is advantageous to provide some separation between hairpins in a polynucleotide comprising multiple hairpins, to improve the processing of the RNA (see for example element F in FIGS. 2A-B). The sequence separating the hairpins should be relatively unstructured. Exemplary unstructured sequences that may be incorporated between hairpins in an inhibitory polynucleotide include sequences given as SEQ ID NOs: 715-722.

It is advantageous to provide some unstructured sequence to the 5' of the first hairpin in an inhibitory polynucleotide. Exemplary unstructured sequences that may be incorporated to the 5' of the first hairpin an inhibitory polynucleotide include sequences given as SEQ ID NOs: 693-694. It is advantageous to provide some unstructured sequence to the 3' of the last hairpin in an inhibitory polynucleotide. Exemplary unstructured sequences that may be incorporated to the 3' of the last hairpin an inhibitory polynucleotide include sequences given as SEQ ID NOs: 695-696.

Although some sequence elements of artificial miRNAs are derived from naturally occurring miRNAs, the combination of guide, loop and passenger strand sequences in each artificial miRNA of the invention, or the combination of guide, loop and passenger strand sequences together with the 5' and 3' hairpin-stabilizing sequences in each artificial miRNA of the invention, are not naturally occurring miRNA sequences.

An exemplary general structure for a multi-hairpin amiRNA gene is shown in FIGS. 2A-B. It comprises (i) a promoter, operably linked to (ii) a spacer sequence preferably of between 50 and 3,000 nucleotides; (iii) an unstructured sequence, optionally from the 5' region of a naturally occurring miRNA; (iv) a first hairpin comprising (a) a first 5' stem sequence (FIGS. 2A-B, element A) which may optionally be derived from the 5' stem (but preferably not the guide or passenger strand sequence) of a naturally occurring miRNA; (b) a first guide (or passenger) strand sequence (FIGS. 2A-B, element B); (c) a first loop sequence (FIGS. 2A-B, element C); (d) a first passenger (if the sequence in (b) was a guide strand sequence) or guide (if the sequence in (b) was a passenger strand sequence) strand sequence (FIGS. 2A-B, element D); (e) a first 3' stem sequence (FIGS. 2A-B, element E) which may optionally be derived from the 3' stem (but preferably not the guide or passenger strand sequence) of a naturally occurring miRNA, and wherein the first 5' stem sequence and the first 3' stem sequence increase the stability of the hairpin formed by the first guide strand sequence and the first passenger strand sequence; (v) optionally an unstructured sequence to separate the first hairpin from the second hairpin (FIGS. 2A-B, element F); (vi) a second hairpin comprising (f) a second 5' stem sequence (FIGS. 2A-B, element G) which may optionally be derived from the 5' stem (but preferably not the guide or passenger strand sequence) of a naturally occurring miRNA; (g) a second guide (or passenger) strand sequence (FIGS. 2A-B, element H); (h) a second loop sequence (FIGS. 2A-B, element I); (j) a second passenger (if the sequence in (g) was a guide strand sequence) or guide (if the sequence in (g) was a passenger strand sequence) strand sequence (FIGS. 2A-B, element J); (k) a second 3' stem sequence (FIGS. 2A-B, element K) which may optionally be derived from the 3' stem (but preferably not the guide or passenger strand sequence) of a naturally occurring miRNA, and wherein the second 5' stem sequence and the second 3' stem sequence increase the stability of the hairpin formed by the second guide strand sequence and the second passenger strand sequence; and wherein the first guide strand sequence and the second guide strand sequence are complementary to the same target mRNA expressed from an endogenous mammalian cell gene, and the first and second guide strand sequences are different from each other.

The inhibitory polynucleotide may be incorporated into cultured mammalian cells either on a transient vector, on a viral vector such as an adenovirus associated viral vector (an AAV vector), on a lentiviral vector or on a vector that integrates into the cell's genome through a process of random integration. The number of copies of an inhibitory gene transfer polynucleotide comprising a multi-hairpin amiRNA gene that are integrated into the genome of a cultured mammalian cell may be increased by incorporating it into a transposon and then using a corresponding transposase to insert multiple copies of the transposon into the mammalian cell genome. An advantageous inhibitory gene transfer polynucleotide comprises two transposon ends, as described in Section 5.2.2.

An inhibitory gene transfer polynucleotide comprising a multi-hairpin amiRNA gene flanked by transposon ends may be stably integrated into the genome of a eukaryotic cell by introducing into the eukaryotic cell the transposon and a corresponding transposase (as described in Section 5.2.2), either as a transposase protein or as a polynucleotide encoding the transposase. Optionally the inhibitory gene transfer polynucleotide may further comprise a selectable marker, which may be used to identify cells whose genome comprises the inhibitory gene transfer polynucleotide and the multi-hairpin amiRNA gene. These cells may also be tested phenotypically to determine the degree by which expression of the target mRNA has been reduced. In some cases, inhibition of the target mRNA may result in a selectable phenotype.

Although it is preferable to incorporate two or more amiRNA hairpins to express guides complementary to the same target mRNA into a single polynucleotide, one can alternatively express two or more amiRNA guides complementary to different target sites of the same target mRNA within the same by using two separate inhibitory gene transfer polynucleotides, providing that both polynucleotides become integrated into the genome of the cultured mammalian cell. Preferably the inhibitory gene transfer polynucleotides comprise transposon ends or lentiviral repeats. A cultured mammalian cell whose genome comprises a first and second amiRNA hairpin, wherein the first and second guide strand sequences are complementary to first and second target sites of the same mRNA, and wherein the first and second guide strand sequences are different from each other is also an aspect of the invention. Preferably the expression of a target gene encoding the mRNA is reduced to a level lower than the level of expression of the target gene in a cultured mammalian control cell whose genome comprises only the first or the second amiRNA hairpin.

A cell whose genome comprises an inhibitory polynucleotide comprising a multi-hairpin amiRNA may have permanently reduced or eliminated activity of the gene encoded by the target mRNA. Such a cell is then useful and valuable for producing molecules that would otherwise be modified as a result of the direct or indirect action of the target mRNA. Such produced molecules may include proteins, sugars, metabolites and other cellular products. Mammalian cell phenotypes that may be modified by inhibitory polynucleotides include the glycosylation of proteins, the intracellular trafficking of proteins, the proteolytic cleavage of proteins, the requirement for particular nutrients to be provided in order for the cell to grow, and the ability of the cell to survive under various conditions. Immune cell phenotypes that may be modified by inhibitory gene transfer polynucleotides include the proliferation, survival, longevity, anergy and exhaustion of the immune cell.

5.2.5 Insulator Elements

When a heterologous polynucleotide is integrated into the genome of a mammalian cell, it is often desirable to prevent genetic elements within the heterologous polynucleotide from influencing expression of endogenous immune cell genes. Similarly, it is often desirable to prevent genes within the heterologous polynucleotide from being influenced by elements in the immune cell genome, for example from being silenced by incorporation into heterochromatin. Insulator elements are known to have enhancer-blocking activity (helping to prevent the genes in the heterologous polynucleotide from influencing the expression of endogenous immune cell genes) and barrier activity (helping to prevent genes within the heterologous polynucleotide from being silenced by incorporation into heterochromatin). Enhancer-blocking activity can result from binding of transcriptional repressor CTCF protein. Barrier activity can result from binding of vertebrate barrier proteins such as USF1 and VEZF1. Useful insulator sequences comprise binding sites for CTCF, USF1 or VEZF1. An advantageous gene transfer system comprises a polynucleotide comprising an insulator sequence comprising a binding site for CTCF, USF1 or VEZF1. More preferably a gene transfer system comprises a polynucleotide comprising two insulator sequences, each comprising a binding site for CTCF, USF1 or VEZF1, wherein the two insulator sequences flank any promoters or enhancers within the heterologous polynucleotide. Advantageous examples of insulator sequences are given as SEQ ID NOs: 993-999.

If a heterologous polynucleotide comprising a promoter or enhancer is integrated into the genome of a mammalian cell without insulator sequences, there is a risk that either the promoter or enhancer elements within the heterologous polynucleotide will influence expression of endogenous immune cell genes (for example oncogenes), or that promoter or enhancer elements within the heterologous polynucleotide will be silenced by incorporation into heterochromatin. When a heterologous polynucleotide is integrated into a target genome following random fragmentation, some genetic elements are often lost, and others may be rearranged. There is thus a significant risk that, if the heterologous polynucleotide comprises insulator elements flanking enhancer and promoter elements, the insulator elements may be rearranged or lost, and the enhancer and promoter elements may be able to influence and be influenced by the genomic environment into which they integrate. It is therefore advantageous to use a transposon gene transfer system, wherein the entire sequence between the two transposon ITRs is integrated, without rearrangement, into the immune cell genome. Advantageous gene transfer systems for integration into immune cell genomes thus comprise a transposon in which elements are arranged in the following order: left transposon end; a first insulator sequence; sequences for expression within the immune cell; a second insulator sequence; right transposon end. The sequences for expression within the immune cell may include any number of regulatory sequences operably linked to any number of open reading frames.

5.2.6 Chimeric Antigen Receptor Elements

A chimeric antigen receptor (CAR) comprises an (extracellular) antigen binding domain, a transmembrane domain and one or more (intracellular) costimulatory/signaling regions.

The antigen binding domain may be derived from a single chain variable fragment (scFv) that specifically recognizes an antigen. An scFv is typically derived from the variable domains of the heavy and light chains of an antibody, or a T-cell receptor.

The transmembrane domain may be derived from a transmembrane protein. Examples include CD8, CD28, the inducible T-cell co-stimulator (ICOS), DNAX accessory molecule 1 (DNAM-1), the cytotoxic T-lymphocyte-associated protein 4 (CTLA-4), signaling lymphocyte activation molecule 1 (SLAM-1), T-cell immunoglobulin mucin domain 1 (TIM-1), an interferon receptor such as interferon receptor A1 or A2, a member of the tumor necrosis factor receptor superfamily such as TNFRSF4 (OX40), TNFRSF5 (CD40), TNFRSF5 (CD27), TNFRSF11A (RANK), TNFRSF13B (CD267), TNFRSF9 (4-IBB), TNFRSF13C (CD268), TNFRSF14 (CD270), TNFRSF17 (CD269), TNFRSF18 (GITR), TNFRSF3 (CD18), TNFRSF6 (Fas), TNFRSF8 (CD30), TNFRSF10A (death receptor 4), TNFRSF1OB (death receptor 5), TNFRSF19 (TROY), TNFRSF21 (DR6) and TNFRSF25 (DR3). Exemplary transmembrane domain sequences are given as SEQ ID NOs: 1124-1150.

The intracellular domain may comprise sequences from the intracellular domains of proteins that have a stimulatory effect on T-cells. Examples include CD28, the inducible T-cell co-stimulator (ICOS), a member of the tumor necrosis factor receptor superfamily such as TNFRSF4 (OX40), TNFRSF5 (CD40), TNFRSF11A (RANK), TNFRSF13B (CD267), TNFRSF9 (4-IBB), TNFRSF13C (CD268), TNFRSF14 (CD270), TNFRSF17 (CD269), TNFRSF18 (GITR), DNAX accessory molecule 1 (DNAM-1), signaling lymphocyte activation molecule 1 (SLAM-1), T-cell immunoglobulin mucin domain 1 (TIM-1) and the CD3 zeta domain. Exemplary stimulatory domain sequences are given as SEQ ID NOs: 1151-1172.

5.2.7 Selection of Target Cells Comprising Gene Transfer Polynucleotides

A target cell whose genome comprises a stably integrated gene transfer polynucleotide may be identified, if the gene transfer polynucleotide comprises a gene encoding a selectable marker, by exposing the target cells to conditions that favor cells expressing the selectable marker ("selection conditions"). It may therefore be advantageous for a gene transfer polynucleotide to comprise a gene encoding a selectable marker.

One class of selectable markers that may be advantageously incorporated into a gene transfer polynucleotide are those that provide a growth advantage to the cell by allowing a cell to survive in the presence of a harmful substance such as an antibiotic, enzyme inhibitor or cellular poison such as neomycin (resistance conferred by an aminoglycoside 3'-phosphotransferase e.g. a polypeptide with sequence selected from SEQ ID NOs: 878-881), puromycin (resistance conferred by puromycin acetyltransferase e.g. a polypeptide with sequence selected from SEQ ID NOs: 884-886), blasticidin (resistance conferred by a blasticidin acetyltransferase and a blasticidin deaminase e.g. a polypeptide with sequence given by SEQ ID NO: 887), hygromycin B (resistance conferred by hygromycin B phosphotransferase e.g. a polypeptide with sequence selected from SEQ ID NO: 882-883 and zeocin (resistance conferred by a binding protein encoded by the ble gene, for example a polypeptide with sequence given by SEQ ID NO: 875).

Another class of selectable markers that may be advantageously incorporated into a gene transfer polynucleotide are those that provide a growth advantage to the cell by allowing the cell to synthesize a metabolically useful substance. One example of such a selectable marker is glutamine synthetase (GS, for example a polypeptide with sequence selected from SEQ ID NOs: 888-892) which allows selection via glutamine metabolism. Glutamine synthase is the enzyme responsible for the biosynthesis of glutamine from glutamate and ammonia, it is a crucial component of the only pathway for glutamine formation in a mammalian cell. In the absence of glutamine in the growth medium, the GS enzyme is essential for the survival of mammalian cells in culture. Some cell lines, for example mouse myeloma cells do not express enough GS enzyme to survive without added glutamine. In these cells a transfected GS gene can function as a selectable marker by permitting growth in a glutamine-free medium. In other cell lines, for example Chinese hamster ovary (CHO), cells express enough GS enzyme to survive without exogenously added glutamine. These cell lines can be manipulated by genome editing techniques including CRISPR/Cas9 to reduce or eliminate the activity of the GS enzyme. In all these cases, GS inhibitors such as methionine sulphoximine (MSX) can be used to inhibit a cell's endogenous GS activity. Selection protocols include introducing a gene transfer polynucleotide comprising sequences encoding a first polypeptide and a glutamine synthase selectable marker, and then treating the cell with inhibitors of glutamine synthase such as methionine sulphoximine. The higher the levels of methionine sulphoximine that are used, the higher the level of glutamine synthase expression is required to allow the cell to synthesize enough glutamine to survive. Some of these cells will also show an increased expression of the first polypeptide. Preferably the GS gene is operably linked to a weak promoter or other sequence elements that attenuate expression as described herein, such that high levels of expression can only occur if many copies of the gene transfer polynucleotide are present, or if they are integrated in a position in the genome where high levels of expression occur. In such cases it may be unnecessary to use the inhibitor methionine sulphoximine: simply synthesizing enough glutamine for cell survival may provide a sufficiently stringent selection if expression of the glutamine synthetase is attenuated.

Another example of a selectable marker gene that may be advantageously incorporated into a gene transfer polynucleotide to provide a growth advantage to the cell by allowing the cell to synthesize a metabolically useful substance is a gene encoding dihydrofolate reductase (DHFR, for example a polypeptide with sequence selected from SEQ ID NO: 876-877) which is required for catalyzing the reduction of 5,6-dihydrofolate (DHF) to 5,6,7,8-tetrahydrofolate (THF). Some cell lines do not express enough DHFR to survive without added hypoxanthine and thymidine (HT). In these cells a transfected DHFR gene can function as a selectable marker by permitting growth in a hypoxanthine and thymidine-free medium. DHFR-deficient cell lines, for example Chinese hamster ovary (CHO) cells can be produced by genome editing techniques including CRISPR/Cas9 to reduce or eliminate the activity of the endogenous DHRF enzyme. DHFR confers resistance to methotrexate (MTX). DHFR can be inhibited by higher levels of methotrexate. Selection protocols include introducing a construct comprising sequences encoding a first polypeptide and a DHFR selectable marker into a cell with or without an endogenous DHFR gene, and then treating the cell with inhibitors of DHFR such as methotrexate. The higher the levels of methotrexate that are used, the higher the level of DHFR expression is required to allow the cell to synthesize enough DHFR to survive. Some of these cells will also show an increased expression of the first polypeptide. Preferably the DHFR gene is operably linked to a weak promoter or other sequence elements that attenuate expression as described above, such that high levels of expression can only occur if many copies of the gene transfer polynucleotide are present, or if they are integrated in a position in the genome where high levels of expression occur.

Another class of selectable markers include those that may be visually detected and then selected, but which do not provide any inherent growth advantage to the cell. Examples include fluorescent or chromogenic proteins (such as genes encoding GFP, RFP etc.) which can be selected for example using flow cytometry. Other selectable markers which do not provide any inherent growth advantage to the cell include genes encoding transmembrane proteins that can bind to a second molecule (protein or small molecule) that can be fluorescently labelled so that the presence of the transmembrane protein can be selected using flow cytometry. Other selectable markers which do not provide any inherent growth advantage to the cell include genes encoding luciferases.

High levels of expression may be obtained from genes encoded on gene transfer polynucleotides that are integrated at regions of the genome that are highly transcriptionally active, or that are integrated into the genome in multiple copies, or that are present extrachromosomally in multiple copies. It is often advantageous to operably link the gene encoding the selectable marker to expression control elements that result in low levels of expression of the selectable polypeptide from the gene transfer polynucleotide and/or to use conditions that provide more stringent selection. Under these conditions, for the expression cell to produce sufficient levels of the selectable polypeptide encoded on the gene transfer polynucleotide to survive the selection conditions, the gene transfer polynucleotide must either be present in a favorable location in the cell's genome for high levels of expression, or a sufficiently high number of copies of the gene transfer polynucleotide must be present, such that these factors compensate for the low levels of expression achievable because of the expression control elements.

Genomic integration of transposons in which a selectable marker is operably linked to regulatory elements that only weakly express the marker usually requires that the transposon be inserted into the target genome by a transposase. By operably linking the selectable marker to elements that result in weak expression, cells are selected which either incorporate multiple copies of the transposon, or in which the transposon is integrated at a favorable genomic location for high expression. Using a gene transfer system that comprises a transposon and a corresponding transposase increases the likelihood that cells will be produced with multiple copies of the transposon, or in which the transposon is integrated at a favorable genomic location for high expression. Gene transfer systems comprising a transposon and a corresponding transposase are thus particularly advantageous when the transposon comprises a selectable marker operably linked to weak promoters.

A gene to be expressed from the gene transfer polynucleotide may be included on the same gene transfer polynucleotide as the selectable marker, with the two genes operably linked to different promoters. In this case low expression levels of the selectable marker may be achieved by using a weakly active constitutive promoter such as the phosphoglycerokinase (PGK) promoter (such as a promoter selected from SEQ ID NOS: 966-974 or 1188), the Herpes Simplex Virus thymidine kinase (HSV-TK) promoter (e.g. SEQ ID NO: 977), the MCI promoter (for example SEQ ID NO: 978), the ubiquitin promoter (for example SEQ ID NO: 975). Other weakly active promoters may be deliberately constructed, for example a promoter attenuated by truncation, such as a truncated promoter from simian virus 40 (SV40) (for example SEQ ID NO: 979-980), or a truncated HSV-TK promoter (for example SEQ ID NO: 976 or 982).

Expression of the selectable marker may also be reduced by destabilizing the mRNA, for example by incorporating amiRNA hairpins into the 3'UTR of the selectable marker. Insertion of multiple miRNA hairpins into the 3' UTR of a GFP gene may reduce expression of the GFP, even though the miRNA is not targeting the GFP (Sun et al., 2006. Multi-miRNA hairpin method that improves gene knockdown efficiency and provides linked multi-gene knockdown. BioTechniques 41:59-63 doi 10.2144/000112203). This is likely because miRNA processing removes the stabilizing 3'UTR structures such as the polyA tail of the gene. Expression levels of a selectable marker may thus be advantageously reduced by the insertion of miRNA hairpin sequences into the 3' UTR of the gene encoding the selectable marker, thereby increasing the productivity of other genes encoded on the gene transfer polynucleotide. An example in which inclusion of amiRNA hairpins in the 3'UTR of a gene encoding a metabolic enzyme increases the yield of another gene encoded on the same gene transfer polynucleotide is shown in Sections 6.1.2.1 and 6.1.2.2. Inclusion of 2 or 3 amiRNA hairpins results in substantially higher expression levels of the other genes encoded on the gene transfer polynucleotide than does inclusion of a single amiRNA hairpin. Two and three hairpins are also more effective at inhibiting their target gene. An advantageous gene transfer polynucleotide comprises a gene encoding a selectable marker operably linked to a Pol II promoter, and further comprises a first and second amiRNA hairpin in the 3'UTR of the selectable marker. Preferably the first amiRNA hairpin comprises a first guide strand sequence of at least 19 or 20 or 21 or 22 contiguous bases complementary to an mRNA target, and the second amiRNA hairpin comprises a second guide strand sequence of at least 19 or 20 or 21 or 22 contiguous bases complementary to a different sequence within the same mRNA target as the first guide strand sequence. Preferably the first guide strand sequence is different from the second guide strand sequence. Optionally the gene transfer polynucleotide comprises a third amiRNA hairpin in the 3'UTR of the selectable marker wherein the third amiRNA hairpin comprises a third guide strand sequence of at least 19 or 20 or 21 or 22 contiguous bases complementary to a different sequence within the same mRNA target, and wherein the third guide strand sequence is different from the first and second guide strand sequences. Preferably the selectable marker provides a growth advantage to the cell, for example by allowing the cell to synthesize a metabolically useful substance, or to survive in the presence of a harmful substance such as an antibiotic, enzyme inhibitor or cellular poison. Preferably the selectable marker is other than a fluorescent protein or chromogenic protein or a protein that catalyzes a fluorogenic or chromogenic reaction and that does not directly benefit the cell.

An advantageous selectable marker gene comprises an open reading frame encoding a polypeptide with sequence at least 90% identical to a sequence selected from SEQ ID NOs: 875-892, operably linked to a weak promoter, for example a sequence selected from SEQ ID NOs: 966-982. Optionally there is an attenuating 5'UTR between the promoter and the glutamine synthetase open reading frame, for example a sequence selected from SEQ ID NOs: 983-986. The 3' UTR of the selectable marker gene comprises a multi-hairpin amiRNA sequence between the open reading frame and the polyadenylation sequence. Preferably the selectable marker gene is part of a transposon, transposable by a corresponding transposase.

The use of transposons and transposases in conjunction with weakly expressed selectable markers has several advantages over non-transposon constructs. One is that linkage between expression of the selectable marker and other genes on the transposon is very high, because a transposase will integrate the entire sequence that lies between the two transposon ends into the genome. In contrast when heterologous DNA is introduced into the nucleus of a eukaryotic cell, for example a mammalian cell, it is gradually broken into random fragments which may either be integrated into the cell's genome or degraded. Thus, if a gene transfer polynucleotide comprising sequences to be expressed and a selectable marker is introduced into a population of cells, some cells will integrate the sequences encoding the selectable marker but not those encoding the other sequences to be expressed, and vice versa. In these circumstances, selection of cells expressing high levels of selectable marker is thus only somewhat correlated with cells that also express high levels of the other genes to be expressed. In contrast, because the transposase integrates all of the sequences between the transposon ends, cells expressing high levels of selectable marker are highly likely to also express high levels of the other genes to be expressed.

A second advantage of transposons and transposases is that they are much more efficient at integrating DNA sequences into the genome. A much higher fraction of the cell population is therefore likely to integrate one or more copies of the gene transfer polynucleotide into their genomes, so there will be a correspondingly higher likelihood of good stable 5xpression of both the selectable marker and the first polypeptide.

A third advantage of piggyBac-like transposons and transposases is that piggyBac-like transposases are biased toward inserting their corresponding transposons into transcriptionally active chromatin. Each cell is therefore likely to integrate the gene transfer polynucleotide into a region of the genome from which genes are well expressed, so there will be a correspondingly higher likelihood of good expression of both the selectable marker and the first polypeptide.

5.3 Micro RNA for Inhibiting Fucosylation of Secreted Proteins

Fucosylation of antibodies inhibits antibody-dependent cell-mediated cytotoxicity (ADCC). Attempts have therefore been made to use RNA interference to reduce core fucosylation in cultured mammalian cells, including by targeting fucosyl transferase 8 (FUT8) the enzyme that catalyzes the transfer of a1,6-linked fucose to the first Nacetylglucosamine in N-linked glycans. Mori et. al. identified two siRNAs directed against FUT8 that resulted in 60% of a secreted antibody being afucosylated, compared with 10% afucosylated in the absence of siRNA (Mori et. al., 2004. Engineering Chinese hamster ovary cells to maximize effector function of produced antibodies using FUT8 siRNA. Biotechnol Bioeng. 88:901-8.). Beuger et. al. identified a FUT8-targeting shRNA that could produce as much as 88% afucosylated antibody (Beuger et. al., 2009. Short-hairpin-RNA-mediated silencing of fucosyltransferase 8 in Chinese-hamster ovary cells for the production of antibodies with enhanced antibody immune effector function. Biotechnol Appl Biochem. 53:31-7). U.S. Pat. Nos. 6,946,292, 7,737, 325, 7,749,753, 7,846,725 and 8,003,781 describe strategies of inhibiting one or more genes in the fucosylation pathvvay including GDP-Mannose 4,6-dehydratase (GMD), alpha-(1, 6)-fucosyl transferase (FUT8) and GDP-fucose transporter 1 (GFT) using RNA interference. Imai-Nishiya et. al. designed a pair of siRNA molecules targeting FUT8 and GDP-mannose 4,6-dehydratase (GMD) which was able to completely abolish fucosylation providing no fucose were present in the media (Imai-Nishiya et. al.,2007. Double knockdown of a1,6-fucosyltransferase (FUT8) and GDP-mannose 4,6-dehydratase (GMD) in antibody-producing cells: a new strategy for generating fully nonfucosylated therapeutic antibodies with enhanced ADCC. BMC Biotechnology 2007, 7:84). However, the presence of fucose compromises the synergistic effect of knocking down these two genes. Natural microRNAs that target FUT8, including miR-122 and miR-34a, have also been identified (Bernardi C. et. al., 2013. Effects of MicroRNAs on Fucosyltra.nsferase 8 (FUT8) Expression in Hepatocarcinorna Cells. PLoS ONE 8(10): e76540. world wide web doi.org/10.1371/jou-mal.pone.0076540), though the effects of these microRNAs were modest.

In many of the RNA interference examples given above, cells with high levels of afucosylation were selected by treating the cells with a fucose-specific lectin such as Lens culinaris agglutinin that kills cells with fucosylated surface molecules. This is because the effectiveness of any individual siRNA sequence is less than 100%, and when genes expressing the siRNAs are introduced into cells, variation in expression levels leads to significant cell-to-cell variability. To overcome these limitations, we designed multi-hairpin amiRNA genes comprising one, two or three guide strand sequences complementary to different sequences within the same mRNA target (the mRNA for FUT8). We also used a piggyBac-like transposon vector to ensure that the amiRNA genes were integrated into transcriptionally active regions of the genome.

Examples described in Section 6.1.1 (including Sections 6.1.1.1, 6.1.1.2 and 6.1.1.3) show that integration into the CHO genome of a transposon comprising multi-hairpin amiRNAs with guide strand sequences complementary to the 3' UTR of CHO FUT8 resulted in a complete lack of fucose (detected by highly sensitive mass spectroscopy) on antibodies produced by the cells. In contrast to previously reported methods, no subsequent lectin-based selection to kill cells that were still producing fucosylated proteins was necessary. Cells were selected only for incorporation of the transposon comprising the multi-hairpin amiRNA gene into the genome. By combining the effectiveness of multiple guide strand sequences targeting multiple different sequences within the same target mRNA, with highly efficient transposase-catalyzed transposon integration into the mammalian genome, the result was elimination of detectable target enzyme expression within the entire population of cells without further selection steps. Each multi-hairpin amiRNA sequence used in these examples comprised a first guide strand sequence comprising a contiguous 19 or 20 or 21 or 22 nucleotide sequence complementary to SEQ ID NO: 1 and a first passenger strand sequence comprising a contiguous 19 or 20 or 21 or 22 nucleotide sequence that is at least 78% identical to the reverse complement of the first guide strand sequence. Each multi-hairpin amiRNA sequence further comprised a second guide strand sequence comprising a contiguous 19 or 20 or 21 or 22 nucleotide sequence complementary to SEQ ID NO: 1 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. Each multi-hairpin amiRNA sequence further comprised a third guide strand sequence comprising a contiguous 19 or 20 or 21 or 22 nucleotide sequence complementary to SEQ ID NO: 1 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence was separated from its respective passenger strand sequence by between 5 and 35 bases. For multi-hairpin amiRNA SEQ ID NOs 724 and 726, each guide strand sequence was separated from its respective passenger strand sequence by a sequence comprising SEQ ID NO: 683. For multi-hairpin amiRNA SEQ ID NO 727, each guide strand sequence was separated from its respective passenger strand sequence by a sequence comprising SEQ ID NO: 684.

An advantageous gene transfer polynucleotide for inhibition of fucosylation in hamster cells comprises a FUT8-inhibiting multi-hairpin amiRNA sequence. The FUT8-inhibiting multi-hairpin amiRNA sequence comprises a first guide strand sequence comprising a contiguous 19 or 20 or 21 or 22 nucleotide sequence complementary to SEQ ID NO: 1 and a first passenger strand sequence comprising a contiguous 19 or 20 or 21 or 22 nucleotide sequence that is at least 78% identical to the reverse complement of the first guide strand sequence. The FUT8-inhibiting multi-hairpin amiRNA sequence further comprises a second guide strand sequence comprising a contiguous 19 or 20 or 21 or 22 nucleotide sequence complementary to SEQ ID NO: 1 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The FUT8-inhibiting multi-hairpin amiRNA sequence may optionally comprise a third guide strand sequence comprising a contiguous 19 or 20 or 21 or 22 nucleotide sequence complementary to SEQ ID NO: 1 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting hamster FUT8 and their respective passenger strand sequences are SEQ ID NOs: 75 and 379, SEQ ID NOs: 76 and 380, SEQ ID NOs: 77 and 381, SEQ ID NOs: 78 and 382, SEQ ID NOs: 79 and SEQ ID NOs: 383, and 80 and 384.

An advantageous gene transfer polynucleotide for inhibition of fucosylation in hamster cells comprises a GMD-inhibiting multi-hairpin amiRNA sequence. The GMD-inhibiting multi-hairpin amiRNA sequence comprises a first guide strand sequence comprising a contiguous 19 or 20 or 21 or 22 nucleotide sequence complementary to SEQ ID NO: 3 and a first passenger strand sequence comprising a contiguous 19 or 20 or 21 or 22 nucleotide sequence that is at least 78% identical to the reverse complement of the first guide strand sequence. The GMD-inhibiting multi-hairpin amiRNA sequence further comprises a second guide strand sequence comprising a contiguous 19 or 20 or 21 or 22 nucleotide sequence complementary to SEQ ID NO: 3 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The GMD-inhibiting multi-hairpin amiRNA sequence may optionally comprise a third guide strand sequence comprising a contiguous 19 or 20 or 21 or 22 nucleotide sequence complementary to SEQ ID NO: 3 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting hamster GMD and their respective passenger strand sequences are SEQ ID NOs: 87 and 391, SEQ ID NOs: 88 and 392, SEQ ID NOs: 89 and 393, SEQ ID NOs: 90 and 394, SEQ ID NOs: 91 and 395, and SEQ ID NOs: 92 and 396.

An advantageous gene transfer polynucleotide for inhibition of fucosylation in hamster cells comprises a GFT-inhibiting multi-hairpin amiRNA sequence. The GFT-inhibiting multi-hairpin amiRNA sequence comprises a first guide strand sequence comprising a contiguous 19 or 20 or 21 or 22 nucleotide sequence complementary to SEQ ID NO: 5 and a first passenger strand sequence comprising a contiguous 19 or 20 or 21 or 22 nucleotide sequence that is at least 78% identical to the reverse complement of the first guide strand sequence. The GFT-inhibiting multi-hairpin amiRNA sequence further comprises a second guide strand sequence comprising a contiguous 19 or 20 or 21 or 22 nucleotide sequence complementary to SEQ ID NO: 5 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The GFT-inhibiting multi-hairpin amiRNA sequence may optionally comprise a third guide strand sequence comprising a contiguous 19 or 20 or 21 or 22 nucleotide sequence complementary to SEQ ID NO: 5 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting hamster GFT and their respective passenger strand sequences are SEQ ID NOs: 93 and 397, SEQ ID NOs: 94 and 398, SEQ ID NOs: 95 and 399, SEQ ID NOs: 96 and 400, SEQ ID NOs: 97 and 401, and SEQ ID NOs: 98 and 402.

An advantageous inhibitory polynucleotide for inhibition of fucosylation in hamster cells comprise a first guide strand sequence comprising a contiguous 19 or 20 or 21 or 22 nucleotide sequence that is perfectly complementary to a natural mammalian cellular mRNA and a first passenger strand sequence comprising a contiguous 19 or 20 or 21 or 22 nucleotide sequence that is at least 78% complementary to the first guide strand sequence, wherein the first guide strand and first passenger strand sequence are separated by between 5 and 35 nucleotides and a second guide strand sequence comprising a contiguous 19 or 20 or 21 or 22 nucleotide sequence that is perfectly complementary to the same natural mammalian cellular mRNA as the first guide strand sequence and a second passenger strand sequence comprising a contiguous 19 or 20 or 21 or 22 nucleotide sequence that is at least 78% complementary to the second guide strand sequence, wherein the second guide strand and second passenger strand sequence are separated by between 5 and 35 nucleotides, and wherein the first and second guide strand sequence are different from each other, and wherein the natural mammalian cellular mRNA comprises a sequence that is at least 98% identical or at least 99% identical to, or perfectly identical to a sequence selected from SEQ ID NO: 1-6. Exemplary multi-hairpin amiRNAs for inhibition of fucosylation in hamster cells include SEQ ID NOs: 725-733.

An advantageous gene transfer polynucleotide for inhibition of fucosylation in human cells comprises a FUT8-inhibiting multi-hairpin amiRNA sequence. The FUT8-inhibiting multi-hairpin amiRNA sequence comprises a first guide strand sequence comprising a contiguous 19 or 20 or 21 or 22 nucleotide sequence complementary to SEQ ID NO: 7 and a first passenger strand sequence comprising a contiguous 19 or 20 or 21 or 22 nucleotide sequence that is at least 78% identical to the reverse complement of the first guide strand sequence. The FUT8-inhibiting multi-hairpin amiRNA sequence further comprises a second guide strand sequence comprising a contiguous 19 or 20 or 21 or 22 nucleotide sequence complementary to SEQ ID NO: 7 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The FUT8-inhibiting multi-hairpin amiRNA sequence may optionally comprise a third guide strand sequence comprising a contiguous 19 or 20 or 21 or 22 nucleotide sequence complementary to SEQ ID NO: 7 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting human FUT8 and their respective passenger strand sequences are SEQ ID NOs: 81 and 385, SEQ ID NOs: 82 and 386, SEQ ID NOs: 83 and 387, SEQ ID NOs: 84 and 388, SEQ ID NOs: 85 and 389, and SEQ ID NOs: 86 and 390.

An advantageous gene transfer polynucleotide for inhibition of fucosylation in human cells comprises a GMD-inhibiting multi-hairpin amiRNA sequence. The GMD-inhibiting multi-hairpin amiRNA sequence comprises a first guide strand sequence comprising a contiguous 19 or 20 or 21 or 22 nucleotide sequence complementary to SEQ ID NO: 8 and a first passenger strand sequence comprising a contiguous 19 or 20 or 21 or 22 nucleotide sequence that is at least 78% identical to the reverse complement of the first guide strand sequence. The GMD-inhibiting multi-hairpin amiRNA sequence further comprises a second guide strand sequence comprising a contiguous 19 or 20 or 21 or 22 nucleotide sequence complementary to SEQ ID NO: 8 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The GMD-inhibiting multi-hairpin amiRNA sequence may optionally comprise a third guide strand sequence comprising a contiguous 19 or 20 or 21 or 22 nucleotide sequence complementary to SEQ ID NO: 8 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting human GMD and their respective passenger strand sequences are SEQ ID NOs: 99 and 403, SEQ ID NOs: 100 and 404, and SEQ ID NOs: 101 and 405.

An advantageous gene transfer polynucleotide for inhibition of fucosylation in human cells comprises a GFT-inhibiting multi-hairpin amiRNA sequence. The GFT-inhibiting multi-hairpin amiRNA sequence comprises a first guide strand sequence comprising a contiguous 19 or 20 or 21 or 22 nucleotide sequence complementary to SEQ ID NO: 9 and a first passenger strand sequence comprising a contiguous 19 or 20 or 21 or 22 nucleotide sequence that is at least 78% identical to the reverse complement of the first guide strand sequence. The GFT-inhibiting multi-hairpin amiRNA sequence further comprises a second guide strand sequence comprising a contiguous 19 or 20 or 21 or 22 nucleotide sequence complementary to SEQ ID NO: 9 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The GFT-inhibiting multi-hairpin amiRNA sequence may optionally comprise a third guide strand sequence comprising a contiguous 19 or 20 or 21 or 22 nucleotide sequence complementary to SEQ ID NO: 9 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting human GFT and their respective passenger strand sequences are SEQ ID NOs: 102 and 406, SEQ ID NOs: 103 and 407, and SEQ ID NOs: 104 and 408.

An advantageous inhibitory polynucleotide for inhibition of fucosylation in human cells comprise a first guide strand sequence comprising a contiguous 19 or 20 or 21 or 22 nucleotide sequence that is perfectly complementary to a natural mammalian cellular mRNA and a first passenger strand sequence comprising a contiguous 19 or 20 or 21 or 22 nucleotide sequence that is at least 78% complementary to the first guide strand sequence, wherein the first guide strand and first passenger strand sequence are separated by between 5 and 35 nucleotides and a second guide strand sequence comprising a contiguous 19 or 20 or 21 or 22 nucleotide sequence that is perfectly complementary to the same natural mammalian cellular mRNA as the first guide strand sequence and a second passenger strand sequence comprising a contiguous 19 or 20 or 21 or 22 nucleotide sequence that is at least 78% complementary to the second guide strand sequence, wherein the second guide strand and second passenger strand sequence are separated by between 5 and 35 nucleotides, and wherein the first and second guide strand sequence are different from each other, and wherein the natural mammalian cellular mRNA comprises a sequence that is at least 98% identical or at least 99% identical to, or perfectly identical to a sequence selected from SEQ ID NO: 7-9. Exemplary multi-hairpin amiRNAs for inhibition of fucosylation in human cells include SEQ ID NOs: 734-736.

5.4 Micro RNA for Modulating Intraceulluar Trafficking of Secreted Proteins

There are several pathways for protein trafficking to lysozomes. When cultured mammalian cells are being used to heterologously produce a protein that is normally delivered to lysozomes, trafficking of the heterologous protein to lysozomes competes with its secretion, and also risks clogging lysozomes and compromising the health (and productivity) of the cultured mammalian cell. Two proteins that have been shown to participate in the trafficking of proteins to lysozomes are sortilin and prosaposin. Inhibition of expression of these two proteins by multi-hairpin amiRNAs can modulate the trafficking of proteins to lysozomes.

An advantageous gene transfer polynucleotide for modulating intracellular protein trafficking in hamster cells comprises a prosaposin-inhibiting multi-hairpin amiRNA sequence. The prosaposin-inhibiting multi-hairpin amiRNA sequence comprises a first guide strand sequence comprising a contiguous 19 or 20 or 21 or 22 nucleotide sequence complementary to SEQ ID NO: 10 and a first passenger strand sequence comprising a contiguous 19 or 20 or 21 or 22 nucleotide sequence that is at least 78% identical to the reverse complement of the first guide strand sequence. The prosaposin-inhibiting multi-hairpin amiRNA sequence further comprises a second guide strand sequence comprising a contiguous 19 or 20 or 21 or 22 nucleotide sequence complementary to SEQ ID NO: 10 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The prosaposin-inhibiting multi-hairpin amiRNA sequence may optionally comprise a third guide strand sequence comprising a contiguous 19 or 20 or 21 or 22 nucleotide sequence complementary to SEQ ID NO: 10 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting hamster prosaposin and their respective passenger strand sequences are SEQ ID NOs: 105 and 409, SEQ ID NOs: 106 and 410, and SEQ ID NOs: 107 and 411.

An advantageous gene transfer polynucleotide for modulating intracellular protein trafficking in hamster cells comprises a sortilin-inhibiting multi-hairpin amiRNA sequence. The sortilin-inhibiting multi-hairpin amiRNA sequence comprises a first guide strand sequence comprising a contiguous 19 or 20 or 21 or 22 nucleotide sequence complementary to SEQ ID NO: 11 and a first passenger strand sequence comprising a contiguous 19 or 20 or 21 or 22 nucleotide sequence that is at least 78% identical to the reverse complement of the first guide strand sequence. The sortilin-inhibiting multi-hairpin amiRNA sequence further comprises a second guide strand sequence comprising a contiguous 19 or 20 or 21 or 22 nucleotide sequence complementary to SEQ ID NO: 11 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The sortilin-inhibiting multi-hairpin amiRNA sequence may optionally comprise a third guide strand sequence comprising a contiguous 19 or 20 or 21 or 22 nucleotide sequence complementary to SEQ ID NO: 11 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting hamster sortilin and their respective passenger strand sequences are SEQ ID NOs: 108 and 412, SEQ ID NOs: 109 and 413, and SEQ ID NOs: 110 and 414.

An advantageous inhibitory polynucleotide for modulation of intracellular protein trafficking in hamster cells comprise a first guide strand sequence comprising a contiguous 19 or 20 or 21 or 22 nucleotide sequence that is perfectly complementary to a natural mammalian cellular mRNA and a first passenger strand sequence comprising a contiguous 19 or 20 or 21 or 22 nucleotide sequence that is at least 78% complementary to the first guide strand sequence, wherein the first guide strand and first passenger strand sequence are separated by between 5 and 35 nucleotides and a second guide strand sequence comprising a contiguous 19 or 20 or 21 or 22 nucleotide sequence that is perfectly complementary to the same natural mammalian cellular mRNA as the first guide strand sequence and a second passenger strand sequence comprising a contiguous 19 or 20 or 21 or 22 nucleotide sequence that is at least 78% complementary to the second guide strand sequence, wherein the second guide strand and second passenger strand sequence are separated by between 5 and 35 nucleotides, and wherein the first and second guide strand sequence are different from each other, and wherein the natural mammalian cellular mRNA comprises a sequence that is at least 98% identical or at least 99% identical to, or perfectly identical to a sequence selected from SEQ ID NOs: 10 and 11. Exemplary multi-hairpin amiRNAs for modulation of intracellular protein trafficking in hamster cells include a sequence selected from SEQ ID NOs: 737-739.

5.5 Micro RNA for Modulating Proteolytic Cleavage of Secreted Proteins

There are many proteases produced by mammalian culture cells. Some of these may adversely affect heterologous proteins produced by the cells. Examples of proteases produced by Chinese hamster cells include carboxypeptidases, such as those with mRNA sequences that are at least 98% identical to or at least 99% identical to, or identical to a sequence given by SEQ ID NOs: 12-20.

An advantageous gene transfer polynucleotide for reducing proteolytic processing of heterologously produced proteins in hamster cells comprises a carboxypeptidase-inhibiting multi-hairpin amiRNA sequence. The carboxypeptidase-inhibiting multi-hairpin amiRNA sequence comprises a first guide strand sequence comprising a contiguous 19 or 20 or 21 or 22 nucleotide sequence complementary to a sequence selected from SEQ ID NO: 12-20 and a first passenger strand sequence comprising a contiguous 19 or 20 or 21 or 22 nucleotide sequence that is at least 78% identical to the reverse complement of the first guide strand sequence. The carboxypeptidase-inhibiting multi-hairpin amiRNA sequence further comprises a second guide strand sequence comprising a contiguous 19 or 20 or 21 or 22 nucleotide sequence complementary to the same mRNA as the first guide strand sequence, and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The carboxypeptidase-inhibiting multi-hairpin amiRNA sequence may optionally comprise a third guide strand sequence comprising a contiguous 19 or 20 or 21 or 22 nucleotide sequence complementary to the same mRNA as the first and second guide strand sequences, and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases.

Carboxypeptidase D has been identified as being responsible for the removal of the C-terminal lysine from antibody heavy chains (Hu et al, 2016. Biotechnol. Bioeng. 113, 2100-6 "Carboxypeptidase D is the Only Enzyme Responsible for Antibody C-Terminal Lysine Cleavage in Chinese Hamster Ovary (CHO) Cells"). An advantageous gene transfer polynucleotide for inhibiting carboxypeptidase D in hamster cells comprises a carboxypeptidase D-inhibiting multi-hairpin amiRNA sequence. The carboxypeptidase D-inhibiting multi-hairpin amiRNA sequence comprises a first guide strand sequence comprising a contiguous 19 or 20 or 21 or 22 nucleotide sequence complementary to SEQ ID NO: 17 and a first passenger strand sequence comprising a contiguous 19 or 20 or 21 or 22 nucleotide sequence that is at least 78% identical to the reverse complement of the first guide strand sequence. The carboxypeptidase D-inhibiting multi-hairpin amiRNA sequence further comprises a second guide strand sequence comprising a contiguous 19 or 20 or 21 or 22 nucleotide sequence complementary to SEQ ID NO: 17 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The s carboxypeptidase D-inhibiting multi-hairpin amiRNA sequence may optionally comprise a third guide strand sequence comprising a contiguous 19 or 20 or 21 or 22 nucleotide sequence complementary to SEQ ID NO: 17 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting hamster carboxypeptidase D and their respective passenger strand sequences are SEQ ID NOs: 111 and 415, SEQ ID NOs: 112 and 416, SEQ ID NOs: 113 and 417, SEQ ID NOs: 1173 and 1174, SEQ ID NOs: 1175 and 1176, SEQ ID NOs: 1177 and 1178. Exemplary multi-hairpin amiRNA for inhibition of carboxypeptidase D in hamster cells includes SEQ ID NOs: 740 and 1179.

5.6 Glutamine Synthetase

Disruption of a natural mammalian gene that normally provides to the cell a protein that is essential for growth, division or survival, such as a gene that encodes an essential metabolic enzyme, can provide an opportunity to develop a metabolic selection system. Some exemplary metabolic selection systems are described in Section 5.2.7. Typically this is accomplished by permanent irreversible disruption of the gene encoding the essential metabolic enzyme, which can be accomplished using a targeted disruption method such as zinc finger nucleases, TALE effector nucleases, CRISPR Cas9-directed nucleases and AAV-directed nucleases, or a random method such as irradiation or other random mutagenesis of the cells with subsequent identification of cells in which the gene encoding the essential metabolic enzyme is disrupted. Cells in which expression of the essential metabolic gene has been disrupted can survive, grow and divide in the absence of this otherwise essential gene if an enzyme, growth factor, nutrient or other molecule is provided exogenously to compensate for the lack of the product of the missing essential metabolic enzyme. Cells in which expression of the essential metabolic gene has been disrupted can then be used as hosts for subsequent introduction of expression polynucleotides which comprise a selectable marker whose function is to complement or compensate for the lack of function of the essential metabolic gene, and one or more other gene to be expressed in the cell. These cells are then subjected to conditions where the enzyme, growth factor, nutrient or other molecule that was provided to allow the cell to grow, is removed. Only cells that have taken up the expression polynucleotide comprising the gene encoding the complementing selectable marker will survive. Previously described examples include CRISPR disruption of the glutamine synthetase gene in human culture cells (Yu et al, 2018. Biotechnol Bioeng. 115: 1367-1372. "Glutamine synthetase gene knockout-human embryonic kidney 293E cells for stable production of monoclonal antibodies."), zinc finger disruption of glutamine synthetase in CHO cells (Fan et al 2012. Biotechnol Bioeng. 109: 1007-15. "Improving the efficiency of CHO cell line generation using glutamine synthetase gene knockout cells."), zinc finger disruption of the DHFR gene in mammalian cells (Santiago et al 2008. Proc Natl Acad Sci USA. 105: 5809-5814. "Targeted gene knockout in mammalian cells by using engineered zinc-finger nucleases"), and deletion of DHFR in CHO cells by irradiation (Urlaub et al, 1983. Cell. 33: 405-12. "Deletion of the diploid dihydrofolate reductase locus from cultured mammalian cells.").

Permanent disruption of the gene sequence has been the method previously used to inhibit expression of essential metabolic enzymes because, in order to provide an appropriate selective pressure, expression of the essential metabolic enzyme must be reduced to below a level that would allow cells to grow. There must also be no "leakiness": if some cells are able to resume expressing the essential metabolic enzyme then they will grow in the absence of the expression polynucleotide comprising the complementing selectable marker, which will create a background of cells not expressing the genes to be expressed that are encoded on the expression polynucleotide. RNA interference has not generally been sufficiently effective at inhibiting the expression of essential metabolic genes, nor sufficiently stable as to ensure the continued inhibition of expression of the essential metabolic gene. However the benefit of an RNA interference approach is that it can be extremely fast to implement, and it can inhibit all copies of a gene in a diploid or polyploid cell simultaneously, without having to independently determine that each genomic copy has been mutationally inactivated. Furthermore, as shown in Examples in Section 6.1.3, a method comprising introduction of a multi-hairpin amiRNA gene for inhibition of an essential metabolic gene into the genome of a pool of cells, and selection of cells whose genomes comprise the multi-hairpin amiRNA gene, can result in a pool of cells in which expression of the essential metabolic enzyme is inhibited to a level that prevents growth of the cell in more than 70% or 80% or 90% or 91% or 92% or 93% or 94% or 95% or 96% or 97% or 98% or 99% of the cells in the pool. This is in contrast with directed cleavage methods such as zinc finger nucleases, TAL effector nucleases (TALENs), CRISPR/Cas9 nucleases or AAV. Such methods are considered effective if they can mutate and inactivate a target gene in between 1% and 10% of the cells into which they are transfected. The multi-hairpin amiRNA approach is thus at least 10-fold more efficient than these nuclease-based gene disruption techniques.

A multi-hairpin amiRNA gene can be integrated into the genome of a mammalian cell to inhibit a natural mammalian gene that normally provides to the cell a protein that is essential for growth (including survival and division). The multi-hairpin amiRNA may be placed into the 3'UTR of a second gene to be expressed within the cell. Preferably the gene encodes an essential metabolic enzyme, such that the cell cannot grow in the absence of this otherwise essential gene unless an enzyme, growth factor, nutrient or other molecule is provided exogenously (we refer to this as an exogenously provided complementing factor). Cells will often have intracellular reserves of various nutrients, so a cell is considered not to grow if the cell can divide only 1, 2, 3 or 4 times after the removal of the exogenously provided complementing factor. A population of cells in which expression of the essential metabolic enzyme has been successfully inhibited will thus increase its viable cell density by no more than 2-fold, 4-fold, 8-fold or 16-fold following removal of the exogenously provided complementing factor. Preferably expression of the essential metabolic enzyme is inhibited such that less than 50% or 40% or 30% or 20% or 10% or 5% or 2% or 1% of the natural enzyme activity remains in the cell. Examples of such proteins include an essential metabolic enzyme involved in the synthesis of an amino acid, an essential metabolic enzyme involved in the synthesis of an amino acid precursor, an essential metabolic enzyme involved in the synthesis of a nucleotide, an essential metabolic enzyme involved in the synthesis of a nucleotide precursor, an essential metabolic enzyme involved in the synthesis of a fatty acid and an essential metabolic enzyme involved in the synthesis of a vitamin. If the multi-hairpin amiRNA gene is stably integrated into the mammalian cell genome, and stably expressed, the essential metabolic enzyme is stably inhibited (absent present of a second compensating gene). A second gene that complements or compensates for the inhibited essential metabolic enzyme may then be used as a selectable marker in the mammalian cell. The second gene may encode an alternative version of the inhibited essential metabolic enzyme that is resistant to inhibition by the multi-hairpin amiRNA, for example by containing differences in its mRNA sequence at the positions of complementarity between the mRNA for the essential metabolic enzyme and the guide strand sequences encoded by the multi-hairpin amiRNA gene. The second gene may alternatively encode one or more enzymes that provide an alternative metabolic pathway to provide the missing essential nutrient. A second polynucleotide comprising the second complementing gene may then be introduced into the mammalian cell, and selection pressure can be applied by withdrawal, at once or by tapered reduction of the exogenously provided enzyme, growth factor, nutrient or other molecule. The only cells that survive such selection are those that have taken up the second polynucleotide and expressed the second gene. The second polynucleotide may comprise other genes that will also be expressed. Preferably the second polynucleotide is a transposon or a viral vector. One advantage of this strategy is that nutrient withdrawal is often a very gentle selection compared with the addition of a drug. Drugs that are commonly used as selectable markers often have pleiotropic effects which may have undesired effects on the mammalian cell (Lanza et al, 2013; Yallop et al, 2003; Yallop et al, 2001; Flintoff et al, 1982). For example, the use of methionine sulfoxamine to inhibit the glutamine synthetase gene reduces the cellular growth rate and increases production of toxic metabolic wastes lactate and ammonia in CHO cells (Noh et al (2018). Comprehensive characterization of glutamine synthetase-mediated selection for the establishment of recombinant CHO cells producing monoclonal antibodies. Scientific Reports, 8, [5361]. world wide web doi.org/10.1038/s41598-01 8-23720-9).

A method for stably introducing into a mammalian cell a polynucleotide for expression comprises (a) introducing into the mammalian cell an inhibitory gene transfer polynucleotide comprising a gene, expressible in the mammalian cell, which encodes an interfering RNA with guide strand sequence(s) complementary to the mRNA for an essential metabolic enzyme; (b) growing the cell in the presence of an enzyme, growth factor, nutrient or other molecule that is provided exogenously to enable the cell to survive, grow and divide while expression of the essential metabolic enzyme is inhibited; (c) introducing into the cell a second polynucleotide comprising (i) a gene encoding a selectable marker expressible in the mammalian cell, wherein the selectable marker functionally complements the lack of the essential metabolic enzyme and removes the requirement for the exogenous provision of the enzyme, growth factor, nutrient or other molecule that enabled the cell to survive, grow and divide while expression of the essential metabolic enzyme was inhibited, and (ii) a second gene expressible in the mammalian cell; and (d) growing the cell in the absence of the enzyme, growth factor, nutrient or other molecule that was provided exogenously in (b) to enable the cell to survive, grow and divide while expression of the essential metabolic enzyme is inhibited, thereby making the cell's survival, growth and division dependent upon the expression of the selectable marker from the second polynucleotide. Preferably the first and second polynucleotides are integrated into the mammalian cell genome. The method optionally also comprises (e) growing the cell under conditions where the second gene in the second polynucleotide is expressed. Optionally the second gene encodes a protein product, and the method further comprises (f) collecting or purifying the protein product encoded by the second gene.

One class of selectable markers that may be advantageously incorporated into a gene transfer polynucleotide are those that provide a growth advantage to the cell by allowing the cell to synthesize a metabolically useful substance. One example of such a selectable marker is glutamine synthetase (GS, for example a polypeptide sequence selected from SEQ ID NOs:888-892) which allows selection via glutamine metabolism. Glutamine synthase is the enzyme responsible for the biosynthesis of glutamine from glutamate and ammonia, it is a crucial component of the only pathway for glutamine formation in a mammalian cell. In the absence of glutamine in the growth medium, the glutamine synthetase enzyme is essential for the survival of mammalian cells in culture. Some cell lines, for example mouse myeloma cells do not express enough glutamine synthetase enzyme to survive without added glutamine.

In some cell lines, for example HEK cells and Chinese hamster ovary (CHO) cells, there is enough glutamine synthetase enzyme expressed to enable the cell to survive without exogenously added glutamine. These cells can be manipulated by genome editing techniques including CRISPR/Cas9 to reduce or eliminate the activity of the endogenous glutamine synthetase enzyme. However even with CRISPR this is a laborious process that may introduce off-target mutations in other genes. An alternative method is to stably integrate into the cell genome a polynucleotide comprising a multi-hairpin amiRNA that targets the endogenous glutamine synthetase gene. An exogenously provided glutamine synthetase gene may then be used as a selectable marker, provided the exogenously provided gene does not comprise the sequences targeted by the guide strand sequence. This may be accomplished by altering the codon used to encode the glutamine synthetase if the guide targets sequences within the open reading frame. It may be accomplished by altering the 5' UTR if the guide targets sequences within the 5' UTR. It may be accomplished by altering the polyadenylation signal of the 3' UTR if the guide targets sequences within the polyadenylation signal sequence/3' UTR.

5.6.1 Micro RNA to Reduce Endogenous Glutamine Synthetase

An advantageous gene transfer polynucleotide for inhibition of glutamine synthetase in hamster cells through RNA interference comprises a glutamine synthetase-inhibiting multi-hairpin amiRNA sequence. The glutamine synthetase-inhibiting multi-hairpin amiRNA sequence comprises a first guide strand sequence comprising a contiguous 19 or 20 or 21 or 22 nucleotide sequence complementary to SEQ ID NO: 21 and a first passenger strand sequence comprising a contiguous 19 or 20 or 21 or 22 nucleotide sequence that is at least 78% identical to the reverse complement of the first guide strand sequence. The glutamine synthetase-inhibiting multi-hairpin amiRNA sequence further comprises a second guide strand sequence comprising a contiguous 19 or 20 or 21 or 22 nucleotide sequence complementary to SEQ ID NO: 21 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The glutamine synthetase-inhibiting multi-hairpin amiRNA sequence may optionally comprise a third guide strand sequence comprising a contiguous 19 or 20 or 21 or 22 nucleotide sequence complementary to SEQ ID NO: 21 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting hamster glutamine synthetase and their respective passenger strand sequences are SEQ ID NOs: 114 and 418, SEQ ID NOs: 115 and 419, SEQ ID NOs: 117 and 421, SEQ ID NOs: 118 and 422, SEQ ID NOs: 119 and 423, SEQ ID NOs: 120 and 424, SEQ ID NOs: 121 and 425, SEQ ID NOs: 122 and 426, SEQ ID NOs: 123 and 427, SEQ ID NOs: 124 and 428, SEQ ID NOs: 125 and 429, SEQ ID NOs: 126 and 430, SEQ ID NOs: 127 and 431, SEQ ID NOs: 128 and 432, SEQ ID NOs: 129 and 433, and SEQ ID NOs: 116 and 420.

Multi-hairpin amiRNA SEQ ID NO: 741 comprises guide strand sequences complementary to three different sequences within the CHO glutamine synthetase mRNA target (SEQ ID NO: 21). Multi-hairpin amiRNA SEQ ID NO: 741 comprised a first guide strand sequence with SEQ ID NO: 114 and a first passenger strand sequence with SEQ ID NO: 418; SEQ ID NO: 741 further comprised a second guide strand sequence with SEQ ID NO: 115 and a second passenger strand sequence with SEQ ID NO: 419; SEQ ID NO: 741 further comprised a third guide strand sequence with SEQ ID NO: 116 and a third passenger strand sequence with SEQ ID NO: 420. Guide strand sequences SEQ ID NO:114, SEQ ID NO: 115, and SEQ ID NO: 116 are all different from each other. Each guide strand sequence was separated from its respective passenger strand sequence by a sequence comprising SEQ ID NO: 683. Incorporation of the multi-hairpin amiRNA into a transposon vector enhances the likelihood that the amiRNA genes will be integrated into transcriptionally active regions of the genome. As described in Section 6.1.3, integration of the multi-hairpin amiRNA with SEQ ID NO: 741 into the genome of a hamster cell reduces expression of glutamine synthetase such that the cell becomes completely dependent upon exogenously supplied glutamine for its survival.

A similar strategy can be used to create glutamine synthetase-deficient human cell lines, such as HEK cell lines. An advantageous gene transfer polynucleotide for inhibition of glutamine synthetase in human cells through RNA interference comprises a glutamine synthetase-inhibiting multi-hairpin amiRNA sequence. The glutamine synthetase-inhibiting multi-hairpin amiRNA sequence comprises a first guide strand sequence comprising a contiguous 19 or 20 or 21 or 22 nucleotide sequence complementary to the mRNA for human glutamine synthetase (e.g. SEQ ID NO: 23) and a first passenger strand sequence comprising a contiguous 19 or 20 or 21 or 22 nucleotide sequence that is at least 78% identical to the reverse complement of the first guide strand sequence. The glutamine synthetase-inhibiting multi-hairpin amiRNA sequence further comprises a second guide strand sequence comprising a contiguous 19 or 20 or 21 or 22 nucleotide sequence complementary to the mRNA for human glutamine synthetase (e.g. SEQ ID NO: 23) and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The glutamine synthetase-inhibiting multi-hairpin amiRNA sequence may optionally comprise a third guide strand sequence comprising a contiguous 19 or 20 or 21 or 22 nucleotide sequence complementary to the mRNA for human glutamine synthetase (e.g. SEQ ID NO: 23) and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NO: 683-692. Exemplary guide strand sequences for inhibiting human glutamine synthetase and their respective passenger strand sequences are SEQ ID NOs: 130 and 434, SEQ ID NOs: 131 and 435, SEQ ID NOs: 132 and 436, SEQ ID NOs: 133 and 437, SEQ ID NOs: 134 and 438, SEQ ID NOs: 135 and 439, SEQ ID NOs: 136 and 440, SEQ ID NOs: 137 and 441, SEQ ID NOs: 138 and 442, SEQ ID NOs: 139 and 443, SEQ ID NOs: 140 and 444, SEQ ID NOs: 141 and 445, and SEQ ID NOs: 142 and 446.

5.6.2 Complementation of Glutamine Synthetase Auxotrophy

In cells lacking a functional glutamine synthetase gene, including cells in which endogenous glutamine synthetase expression is reduced by RNA interference (for example by integration of multi-hairpin amiRNA gene comprising SEQ ID NO: 741 into the genome of the cell) an exogenously added glutamine synthetase gene can function as a selectable marker by permitting growth in a glutamine-free medium. Preferably a gene transfer polynucleotide comprising the exogenous glutamine synthetase gene is introduced into the cell. Preferably the exogenous glutamine synthetase gene comprises sequence features that prevent its expression from being inhibited by any RNA interference that has been used to make the host cell auxotrophic for glutamine synthetase. If RNA interference molecules, including amiRNA guide strands, are complementary to the coding portion of the endogenous glutamine synthetase, an exogenous gene encoding glutamine synthetase can avoid inhibition if the coding sequence is changed, for example by silent mutations in the targeted region. If RNA interference molecules, including amiRNA guide strands, are complementary to the 3' UTR or 5' UTR portions of the endogenous glutamine synthetase, an exogenous gene encoding glutamine synthetase can avoid inhibition by replacing the natural UTR sequences with alternative sequences, for example synthetic sequences or UTR sequences taken or adapted from other natural genes.

Selection protocols include introducing a gene transfer polynucleotide comprising sequences encoding a glutamine synthase selectable marker, and then growing the cell in media that does not contain enough glutamine for the cells to survive in the absence of an exogenous gene encoding glutamine synthetase.

Preferably the exogenous gene encoding glutamine synthetase gene is operably linked to a weak promoter or other sequence elements that attenuate expression, such that high levels of expression can only occur if many copies of the gene transfer polynucleotide are present, or if they are integrated in a position in the genome where high levels of expression occur. In such cases it may be unnecessary to use a glutamine synthetase inhibitor such as methionine sulphoximine: simply synthesizing enough glutamine for cell survival may provide a sufficiently stringent selection if expression of the glutamine synthetase is attenuated. Exemplary glutamine synthetase polypeptide sequences are given as SEQ ID NOs: 888-892.

5.7 Dihydrofolate Reductase

Another example of a selectable marker gene that may be advantageously incorporated into a gene transfer polynucleotide to provide a growth advantage to the cell by allowing the cell to synthesize a metabolically useful substance is a gene encoding dihydrofolate reductase (DHFR, for example a polypeptide sequence selected from SEQ ID NO: 876-877) which is required for catalyzing the reduction of 5,6-dihydrofolate (DHF) to 5,6,7,8-tetrahydrofolate (THF). Some cell lines do not express enough DHFR to survive without added hypoxanthine and thymidine (HT). In these cells a transfected DHFR gene can function as a selectable marker by permitting growth in a hypoxanthine and thymidine-free medium. DHFR confers resistance to methotrexate (MTX). DHFR can be inhibited by higher levels of methotrexate. Selection protocols include introducing a construct comprising sequences encoding a DHFR selectable marker into a cell with or without an endogenous DHFR gene, and then treating the cell with inhibitors of DHFR such as methotrexate. The higher the levels of methotrexate that are used, the higher the level of DHFR expression is required to allow the cell to synthesize enough DHFR to survive. Preferably the DHFR gene is operably linked to a weak promoter or other sequence elements that attenuate expression as described above, such that high levels of expression can only occur if many copies of the gene transfer polynucleotide are present, or if they are integrated in a position in the genome where high levels of expression occur.

Preferably the DHFR gene is operably linked to a weak promoter or other sequence elements that attenuate expression as described herein, such that high levels of expression can only occur if many copies of the gene transfer polynucleotide are present, or if they are integrated in a position in the genome where high levels of expression occur. In such cases it may be unnecessary to use a DHFR inhibitor such as methotrexate: simply synthesizing enough tetrahydrofolate for cell survival may provide a sufficiently stringent selection if expression of the DHFR is attenuated.

In some cell lines, for example HEK cells and Chinese hamster ovary (CHO) cells, there is enough DHFR enzyme expressed to enable the cell to survive without exogenously added HT. These cells can be manipulated by genome editing techniques including CRISPR/Cas9 to reduce or eliminate the activity of the DHFR enzyme. However even with CRISPR this is a laborious process that may introduce off-target mutations in other genes. An alternative method is to stably integrate into the cell genome a polynucleotide comprising a multi-hairpin amiRNA that targets the endogenous DHFR mRNA.

5.7.1 Micro RNA to Reduce Endogenous Dihydrofolate Reductase

An advantageous gene transfer polynucleotide for inhibition of dihydrofolate reductase in hamster cells comprises a dihydrofolate reductase-inhibiting multi-hairpin amiRNA sequence. The dihydrofolate reductase-inhibiting multi-hairpin amiRNA sequence comprises a first guide strand sequence comprising a contiguous 19 or 20 or 21 or 22 nucleotide sequence complementary to hamster DHFR mRNA (whose sequence is given by SEQ ID NO: 22) and a first passenger strand sequence comprising a contiguous 19 or 20 or 21 or 22 nucleotide sequence that is at least 78% identical to the reverse complement of the first guide strand sequence. The dihydrofolate reductase-inhibiting multi-hairpin amiRNA sequence further comprises a second guide strand sequence comprising a contiguous 19 or 20 or 21 or 22 nucleotide sequence complementary to SEQ ID NO: 22 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The dihydrofolate reductase-inhibiting multi-hairpin amiRNA sequence may optionally comprise a third guide strand sequence comprising a contiguous 19 or 20 or 21 or 22 nucleotide sequence complementary to SEQ ID NO: 22 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. Exemplary sequences for separating a guide strand sequence from its passenger strand sequence are sequences that comprise a sequence selected from SEQ ID NOs: 683-692. Exemplary guide strand sequences for inhibiting hamster dihydrofolate reductase and their respective passenger strand sequences are SEQ ID NOs: 143 and 447, SEQ ID NOs: 144 and 448, and SEQ ID NOs: 145 and 449.

Multi-hairpin amiRNA SEQ ID NO: 742 comprises guide strand sequences complementary to different sequences within the CHO dihydrofolate reductase mRNA target (SEQ ID NO: 22). The multi-hairpin amiRNA sequence comprised a first guide strand sequence comprising a contiguous 19 or 20 or 21 or 22 nucleotide sequence complementary to SEQ ID NO: 22 and a first passenger strand sequence comprising a contiguous 19 or 20 or 21 or 22 nucleotide sequence that is at least 78% identical to the reverse complement of the first guide strand sequence. The multi-hairpin amiRNA sequence further comprised a second guide strand sequence comprising a contiguous 19 or 20 or 21 or 22 nucleotide sequence complementary to SEQ ID NO: 22 and a second passenger strand sequence comprising a contiguous 19 or 20 or 21 or 22 nucleotide sequence that is at least 78% identical to the reverse complement of the second guide strand sequence, and wherein the first and second guide strand sequences are different from each other. The multi-hairpin amiRNA sequence further comprised a third guide strand sequence comprising a contiguous 19 or 20 or 21 or 22 nucleotide sequence complementary to SEQ ID NO: 22 and a third passenger strand sequence comprising a contiguous 19 or 20 or 21 or 22 nucleotide sequence that is at least 78% identical to the reverse complement of the third guide strand sequence, and wherein the first, second and third guide strand sequences are all different from each other. Each guide strand sequence is separated from its respective passenger strand sequence by between 5 and 35 bases. For multi-hairpin amiRNA SEQ ID NO 742, each guide strand sequence is separated from its respective passenger strand sequence by a sequence comprising SEQ ID NO: 683. Multi-hairpin amiRNA SEQ ID NO: 742 comprises a first guide strand sequence with SEQ ID NO: 143 and a first passenger strand sequence with SEQ ID NO: 447; SEQ ID NO: 742 further comprises a second guide strand sequence with SEQ ID NO: 144 and a second passenger strand sequence with SEQ ID NO: 448; SEQ ID NO: 742 further comprises a third guide strand sequence with SEQ ID NO: 145 and a third passenger strand sequence with SEQ ID NO: 449. Guide strand sequences SEQ ID NO: 143, SEQ ID NO: 144, and SEQ ID NO: 145 are all different from each other.

5.7.2 Complementation of DHFR Auxotrophy

In cells lacking a functional DHFR gene, including cells in which endogenous DHFR expression is reduced by RNA interference, an exogenously added DHFR gene can function as a selectable marker by permitting growth in HT-free medium. Preferably a gene transfer polynucleotide comprising the exogenous DHFR gene is introduced into the cell. Preferably the exogenous DHFR gene comprises sequence features that prevent its expression from being inhibited by any RNA interference that has been used to make the host cell auxotrophic for DHFR. If RNA interference molecules, including amiRNA guide strand s, are directed against the coding portion of the endogenous DHFR, an exogenous gene encoding DHFR can avoid inhibition if the coding sequence is changed, for example by silent mutations in the targeted region. If RNA interference molecules, including amiRNA guide strand s, are directed against the 3' UTR or 5' UTR portions of the endogenous DHFR, an exogenous gene encoding DHFR can avoid inhibition by replacing the natural UTR sequences with alternative sequences, for example UTR sequences taken or adapted from other natural genes.

Selection protocols include introducing a gene transfer polynucleotide comprising sequences encoding a DHFR selectable marker, and then growing the cell in media that does not contain enough HT for the cells to survive in the absence of an exogenous gene encoding DHFR.

Preferably the exogenous gene encoding DHFR gene is operably linked to a weak promoter or other sequence elements that attenuate expression, such that high levels of expression can only occur if many copies of the gene transfer polynucleotide are present, or if they are integrated in a position in the genome where high levels of expression occur. In such cases it may be unnecessary to use a DHFR inhibitor such as methionine sulphoximine: simply synthesizing enough glutamine for cell survival may provide a sufficiently stringent selection if expression of the DHFR is attenuated. Exemplary DHFR polypeptide sequences are given as SEQ ID NOs: 876-877.

5.8 Endogenous Gene Targets for Modifying Immune Cell Function

For immune cells to respond adequately to threats to the body, they must be able to survive for long enough to attack their targets. For therapies and research that require the ex vivo manipulation of immune cells, it is advantageous for the immune cells to proliferate. However, neither ex vivo culture conditions nor certain in vivo environments (for example the environment within a solid tumor) are optimal for growth of immune cells. For example, T-cells from heavily pre-treated lymphoma patients show lower rates of ex vivo expansion and clinical response when engineered with anti-CD19 chimeric antigen receptor than T-cells from untreated patients. Further, T-cells exposed to target antigen for prolonged periods of time can become anergic or exhausted, and this anergy or exhaustion is often mediated through receptors expressed by the T-cell and present on the surface of the T-cell. There is therefore a need for methods that enhance the function, persistence and proliferation of human immune cells, particularly under conditions that are naturally hostile to the immune cells.

RNA interference is an advantageous mechanism by which to inhibit endogenous cellular genes. One approach to enhance the persistence and proliferation of human immune cells is to integrate into the genome of the immune cell inhibitory polynucleotides that inhibit the expression of certain endogenous immune cell target genes. Candidate target genes include those whose normal function is to reduce proliferation, participate in apoptosis or participate in the anergy or exhaustion pathways. Artificial microRNAs may be encoded on a polynucleotide that also carries a second gene capable of modifying the function of an immune cell, such as a chimeric antigen receptor. Preferably the polynucleotide is a transposon or a viral vector to ensure that both the amiRNA and the chimeric antigen receptor are integrated together into the immune cell genome.

Candidate RNA interference target genes whose normal function is to reduce proliferation or participate in apoptosis include caspase 3, caspase 7, caspase 8, caspase 9, caspase 10, death receptor 4 (tumor necrosis factor receptor superfamily member 10A), death receptor 5 (tumor necrosis factor receptor superfamily member 10B), FAS (tumor necrosis factor receptor superfamily member 6), cytotoxic T-lymphocyte protein 4, apoptosis regulator BAX and BAD (Bcl2-associated agonist of cell death). Candidate RNA interference target genes whose normal function is to participate in the exhaustion pathway include transcription factors thymocyte selection-associated high mobility group box proteins TOX and TOX2, programmed cell death protein 1 (PD-1), T-cell immunoglobulin mucin receptor 3 (TIM-3) and nuclear receptor subfamily 4 group A members 1, 2 and 3 (NR4A1, NR4A2 and NR4A3).

5.8.1 TOX

The thymocyte selection-associated high mobility group box protein TOX has been implicated in inducing and/or maintaining a hyporesponsive, exhausted or dysfunctional state that is triggered by chronic antigen stimulation and characterized by upregulation of several inhibitory receptors and loss of effector function (Seo et. al. 2019. Proc. Natl. Acad. Sci. U.S.A. 116, 12410-12415. "TOX and TOX2 transcription factors cooperate with NR4A transcription factors to impose CD8+T cell exhaustion"). Repression of the TOX gene in mice improved the performance of T-cells expressing a chimeric antigen receptor. It is therefore advantageous to inhibit expression of this gene in T-cells, using multi-hairpin amiRNAs.

An advantageous gene transfer polynucleotide for inhibition of TOX in human immune cells comprises a TOX-inhibiting multi-hairpin amiRNA sequence. The TOX-inhibiting multi-hairpin amiRNA sequence comprises a first guide sequence comprising a contiguous 19 nucleotide sequence complementary to the sequence of the human TOX mRNA (SEQ ID NO: 24), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the TOX mRNA that is to the 3' of the open reading frame (SEQ ID NO: 25). The TOX-inhibiting multi-hairpin amiRNA sequence further comprises a second guide sequence comprising a contiguous 19 nucleotide sequence complementary to SEQ ID NO: 24 and a second passenger sequence comprising a contiguous 19 nucleotide sequence that is at least 78% identical to the reverse comple-ment of the second guide sequence, and wherein the first and second guide sequences are different from each other. The TOX-inhibiting multi-hairpin amiRNA sequence may optionally comprise a third guide sequence comprising a contiguous 19 nucleotide sequence complementary to SEQ ID NO: 24 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting TOX in human immune cells and their respective passenger sequences are SEQ ID NOs: 146 and 450, SEQ ID NOs: 147 and 451, SEQ ID NOs: 148 and 452, SEQ ID NOs: 149 and 453, SEQ ID NOs: 150 and 454, SEQ ID NOs: 151 and 455, SEQ ID NOs: 152 and 456, SEQ ID NOs: 153 and 457, SEQ ID NOs: 154 and 458, SEQ ID NOs: 155 and 459, SEQ ID NOs: 156 and 460, SEQ ID NOs: 157 and 461. Exemplary multi-hairpin amiRNA sequences for inhibition of human TOX are SEQ ID NO: 743-746.

A preferred embodiment comprises a polynucleotide comprising a multi-hairpin amiRNA targeting TOX, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting TOX comprises two hairpins, each hairpin comprising a different sequence of at least 19 contiguous bases that are complementary to TOX mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting TOX, wherein said polynucleotide is part of a transposon. The transposon comprises transposon ends, such that when the transposon is introduced into an immune cell and the immune cell expresses a corresponding transposase, the multi-hairpin amiRNA targeting TOX is integrated into the genome of the immune cell. An immune cell modified by a transposon-borne multi-hairpin amiRNA targeting TOX comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the TOX mRNA may have permanently reduced or eliminated activity of the TOX gene. Optionally the multi-hairpin amiRNA comprising two guide sequences complementary to two different sequences within the TOX mRNA is operably linked to the same promoter as a gene encoding a chimeric antigen receptor. Reduction of TOX expression may alleviate the phenotype of exhaustion of tumor-infiltrating lymphocytes. A T-cell whose genome comprises an inhibitory polynucleotide comprising a multihairpin amiRNA comprising two guide sequences complementary to two different sequences within the TOX mRNA may have an improved ability to kill tumor cells.

5.8.2 TOX2

The thymocyte selection-associated high mobility group box protein TOX2 has been implicated in inducing and/or maintaining a hyporesponsive, exhausted or dysfunctional state that is triggered by chronic antigen stimulation and characterized by upregulation of several inhibitory receptors and loss of effector function (Seo et. al. 2019. Proc. Natl. Acad. Sci. U.S.A. 116, 12410-12415. "TOX and TOX2 transcription factors cooperate with NR4A transcription factors to impose CD8+T cell exhaustion"). Repression of the TOX2 gene in mice improved the performance of T-cells expressing a chimeric antigen receptor. It is therefore advantageous to inhibit expression of this gene in T-cells, using multi-hairpin amiRNAs.

An advantageous gene transfer polynucleotide for inhibition of TOX2 in human immune cells comprises a TOX2-inhibiting multi-hairpin amiRNA sequence. The TOX2-inhibiting multi-hairpin amiRNA sequence comprises a first guide sequence comprising a contiguous 19 nucleotide sequence complementary to the sequence of the human TOX2 mRNA (SEQ ID NO: 26), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the TOX2 mRNA that is to the 3' of the open reading frame (SEQ ID NO: 27). The TOX2-inhibiting multi-hairpin amiRNA sequence further comprises a second guide sequence comprising a contiguous 19 nucleotide sequence complementary to SEQ ID NO: 26 and a second passenger sequence comprising a contiguous 19 nucleotide sequence that is at least 78% identical to the reverse complement of the second guide sequence, and wherein the first and second guide sequences are different from each other. The TOX2-inhibiting multi-hairpin amiRNA sequence may optionally comprise a third guide sequence comprising a contiguous 19 nucleotide sequence complementary to SEQ ID NO: 26 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting human TOX2 in immune cells and their respective passenger sequences are SEQ ID NOs: 158 and 462, SEQ ID NOs: 463 and 392, SEQ ID NOs: 160 and 464, SEQ ID NOs: 161 and 465, SEQ ID NOs: 162 and 466, SEQ ID NOs: 163 and 467, SEQ ID NOs: 164 and 468, SEQ ID NOs: 165 and 469, SEQ ID NOs: 166 and 470, SEQ ID NOs: 167 and 471, SEQ ID NOs: 168 and 472, SEQ ID NOs: 169 and 473, SEQ ID NOs: 170 and 474. Exemplary multi-hairpin amiRNA sequences for inhibition of human TOX2 are SEQ ID NO: 747-750.

A preferred embodiment comprises a polynucleotide comprising a multi-hairpin amiRNA targeting TOX2, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting TOX2 comprises two hairpins, each hairpin comprising a different sequence of at least 19 contiguous bases that are complementary to TOX2 mRNA and each hairpin operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting TOX2, wherein said polynucleotide is part of a transposon. The transposon comprises transposon ends, such that when the transposon is introduced into an immune cell and the immune cell expresses a corresponding transposase, the multi-hairpin amiRNA targeting TOX2 is integrated into the genome of the immune cell. An immune cell modified by a transposon-borne multi-hairpin amiRNA targeting TOX2 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the TOX2 mRNA may have permanently reduced or eliminated activity of the TOX2 gene. Optionally the multi-hairpin amiRNA comprising two guide sequences complementary to two different sequences within the TOX2 mRNA is operably linked to the same promoter as a gene encoding a chimeric antigen receptor. Reduction of TOX2 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the TOX2 mRNA may have an improved ability to kill tumor cells.

5.8.3 TOX1 and TOX2

The thymocyte selection-associated high mobility group box proteins TOX1 and TOX2 have been implicated together in inducing and/or maintaining a hyporesponsive, exhausted or dysfunctional state that is triggered by chronic antigen stimulation and characterized by upregulation of several inhibitory receptors and loss of effector function (Seo et. al. 2019. Proc. Natl. Acad. Sci. U.S.A. 116, 12410-12415. "TOX and TOX2 transcription factors cooperate with NR4A transcription factors to impose CD8+T cell exhaustion"). Repression of both TOX1 and TOX2 together in mice improved the performance of T-cells expressing a chimeric antigen receptor. It is therefore advantageous to inhibit expression of both of these genes in T-cells simultaneously, using multi-hairpin amiRNAs.

An advantageous gene transfer polynucleotide for inhibition of TOX1 and TOX2 in human immune cells comprises a multi-hairpin amiRNA sequence with guides complementary to mRNAs for both. The TOX/TOX2-inhibiting multi-hairpin amiRNA sequence comprises a first guide sequence comprising a contiguous 19 nucleotide sequence complementary to the sequence of the human TOX mRNA (SEQ ID NO: 24), and a first passenger sequence comprising a contiguous 19 nucleotide sequence that is at least 78% identical to the reverse complement of the first guide sequence. The TOX/TOX2-inhibiting multi-hairpin amiRNA sequence further comprises a second guide sequence comprising a contiguous 19 nucleotide sequence complementary to SEQ ID NO: 24 and a second passenger sequence comprising a contiguous 19 nucleotide sequence that is at least 78% identical to the reverse complement of the second guide sequence, and wherein the first and second guide sequences are different from each other. The TOX/TOX2-inhibiting multi-hairpin amiRNA sequence further comprises a third guide sequence comprising a contiguous 19 nucleotide sequence complementary to the sequence of the human TOX2 mRNA (SEQ ID NO: 26), and a third passenger sequence comprising a contiguous 19 nucleotide sequence that is at least 78% identical to the reverse complement of the first guide sequence. The TOX/TOX2-inhibiting multi-hairpin amiRNA sequence further comprises a fourth guide sequence comprising a contiguous 19 nucleotide sequence complementary to SEQ ID NO: 26 and a fourth passenger sequence comprising a contiguous 19 nucleotide sequence that is at least 78% identical to the reverse complement of the second guide sequence, and wherein the third and fourth guide sequences are different from each other. Each guide sequence is separated from its respective passenger sequence by between 5 and 35 bases. The hairpins may occur in any order in the inhibitory gene transfer polynucleotide. For example, the two hairpins comprising guides complementary to TOX may be adjacent to each other, or they may be separated from one another by one or more hairpins comprising guides complementary to TOX2. Conversely the two hairpins comprising guides complementary to TOX2 may be adjacent to each other, or they may be separated from one another by one or more hairpins comprising guides complementary to TOX. Exemplary multi-hairpin amiRNA sequences for inhibition of human TOX and TOX2 are SEQ ID NO: 751-754. Other exemplary multi-hairpin amiRNA sequences for inhibition of TOX and TOX2 may be obtained by selecting a sequence from SEQ ID NOs: 743-746, and a sequence from SEQ ID NOs: 747-750 and joining the two sequences together. The order of the two sequences does not matter.

A preferred embodiment comprises a polynucleotide comprising a multi-hairpin amiRNA targeting TOX and TOX2, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting TOX and TOX2 comprises four hairpins, each hairpin comprising a different sequence of at least 19 contiguous bases, two of which are complementary to TOX mRNA and two of which are complementary to TOX2 mRNA and each hairpin operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting TOX and TOX2, wherein said polynucleotide is part of a transposon. The transposon comprises transposon ends, such that when the transposon is introduced into an immune cell and the immune cell expresses a corresponding transposase, the multi-hairpin amiRNA targeting TOX and TOX2 is integrated into the genome of the immune cell. An immune cell modified by a transposon-borne multi-hairpin amiRNA targeting TOX and TOX2 comprises four hairpins, each hairpin comprising a different sequence of at least 19 contiguous bases, two of which are complementary to TOX mRNA and two of which are complementary to TOX2 mRNA and each hairpin operably linked to a heterologous promoter that is active in a human immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising four guide sequences complementary to two different sequences within the TOX mRNA and two different sequences within the TOX2 mRNA may have permanently reduced or eliminated activity of the TOX and TOX2 genes. Optionally the multi-hairpin amiRNA comprising four guide sequences complementary to two different sequences within the TOX mRNA and two different sequences within the TOX2 mRNA is operably linked to the same promoter as a gene encoding a chimeric antigen receptor. Reduction of TOX and TOX2 expression may alleviate the phenotype of exhaustion of tumor-infiltrating lymphocytes. A T-cell whose genome comprises an inhibitory polynucleotide comprising a multi-hairpin amiRNA comprising four guide sequences complementary to two different sequences within the TOX mRNA and two different sequences within the TOX2 mRNA may have an improved ability to kill tumor cells.

5.8.4 PD-1

Programmed cell death protein 1 (PD-1) is an immune checkpoint with role in downregulating the immune system by suppressing T-cell activity and promoting apoptosis. Exhausted T-cells express high levels of PD-1 (Jiang et. al., 2015. Cell Death & Disease 6, el 972 world wide web doi.org/10.1038/cddis.2015.162. "T-cell exhaustion in the tumor microenvironment"). Treatment off-cells with siRNA directed against PD-1 has improved in vitro CAR-T-cell functionality (Simon et al, 2018. Exp Dermatol. 27:769-778. "The siRNA mediated downregulation of PD-1 alone or simultaneously with CTLA-4 shows enhanced in vitro CAR-T-cell functionality for further clinical development towards the potential use in immunotherapy of melanoma"). It is therefore advantageous to inhibit expression of this gene in T-cells, using multi-hairpin amiRNAs.

An advantageous gene transfer polynucleotide for inhibition of PD-1 in human immune cells comprises a PD-1-inhibiting multi-hairpin amiRNA sequence. The PD-1-inhibiting multi-hairpin amiRNA sequence comprises a first guide sequence comprising a contiguous 19 nucleotide sequence complementary to the sequence of the human PD-1 mRNA (SEQ ID NO: 28), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the PD-1 mRNA that is to the 3' of the open reading frame (SEQ ID NO: 29). The PD-1-inhibiting multi-hairpin amiRNA sequence further comprises a second guide sequence comprising a contiguous 19 nucleotide sequence complementary to SEQ ID NO: 28 and a second passenger sequence comprising a contiguous 19 nucleotide sequence that is at least 78% identical to the reverse complement of the second guide sequence, and wherein the first and second guide sequences are different from each other. The PD-1-inhibiting multi-hairpin amiRNA sequence may optionally comprise a third guide sequence comprising a contiguous 19 nucleotide sequence complementary to SEQ ID NO: 28 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting human PD-1 in immune cells and their respective passenger sequences are SEQ ID NOs: 171 and 475, SEQ ID NOs: 172 and 476, SEQ ID NOs: 173 and 477, SEQ ID NOs: 174 and 478, SEQ ID NOs: 175 and 479, SEQ ID NOs:176 and 480, SEQ ID NOs: 177 and 481, SEQ ID NOs: 178 and 482, SEQ ID NOs: 179 and 483, SEQ ID NOs: 180 and 484. Exemplary multi-hairpin amiRNA sequences for inhibition of human PD-1 are SEQ ID NO: 755-758.

A preferred embodiment comprises a polynucleotide comprising a multi-hairpin amiRNA targeting PD-1, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting PD-1 comprises two hairpins, each hairpin comprising a different sequence of at least 19 contiguous bases that are complementary to PD-1 mRNA and each hairpin operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting PD-1, wherein said polynucleotide is part of a transposon. The transposon comprises transposon ends, such that when the transposon is introduced into an immune cell and the immune cell expresses a corresponding transposase, the multi-hairpin amiRNA targeting PD-1 is integrated into the genome of the immune cell. An immune cell modified by a transposon-borne multi-hairpin amiRNA targeting PD-1 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the PD-1 mRNA may have permanently reduced or eliminated activity of the PD-1 gene. Optionally the multi-hairpin amiRNA comprising two guide sequences complementary to two different sequences within the PD-1 mRNA is operably linked to the same promoter as a gene encoding a chimeric antigen receptor. Reduction of PD-1 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the PD-1 mRNA may have an improved ability to kill tumor cells.

5.8.5 CTLA-4

Cytotoxic T-lymphocyte protein 4 (CTLA-4) is a protein receptor that functions as an immune checkpoint to down-regulate the immune system. Exhausted T-cells express high levels of CTLA-4 (Jiang et. al., 2015. Cell Death & Disease 6, e1972 world wide web doi.org/10.1038/cddis.2015.162. "T-cell exhaustion in the tumor microenvironment"). Treatment off-cells with siRNA directed against CTLA-4 has improved in vitro CAR-T-cell functionality (Simon et al, 2018. Exp Dermatol. 27:769-778. "The siRNA-mediated downregulation of PD-1 alone or simultaneously with CTLA-4 shows enhanced in vitro CAR-T-cell functionality for further clinical development towards the potential use in immunotherapy of melanoma"). It is therefore advantageous to inhibit expression of this gene in T-cells, using multi-hairpin amiRNAs.

An advantageous gene transfer polynucleotide for inhibition of CTLA-4 in human immune cells comprises a CTLA-4-inhibiting multi-hairpin amiRNA sequence. The CTLA-4-inhibiting multi-hairpin amiRNA sequence comprises a first guide sequence comprising a contiguous 19 nucleotide sequence complementary to the sequence of the human CTLA-4 mRNA (SEQ ID NO: 30), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the CTLA-4 mRNA that is to the 3' of the open reading frame (SEQ ID NO: 31). The CTLA-4-inhibiting multi-hairpin amiRNA sequence further comprises a second guide sequence comprising a contiguous 19 nucleotide sequence complementary to SEQ ID NO: 30 and a second passenger sequence comprising a contiguous 19 nucleotide sequence that is at least 78% identical to the reverse complement of the second guide sequence, and wherein the first and second guide sequences are different from each other. The CTLA-4-inhibiting multi-hairpin amiRNA sequence may optionally comprise a third guide sequence comprising a contiguous 19 nucleotide sequence complementary to SEQ ID NO: 30 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting human CTLA-4 in immune cells and their respective passenger sequences are SEQ ID NOs: 181 and 485, SEQ ID NOs: 182 and 486, SEQ ID NOs: 183 and 487, SEQ ID NOs: 184 and 488, SEQ ID NOs: 185 and 489, SEQ ID NOs: 186 and 490, SEQ ID NOs: 187 and 491, SEQ ID NOs: 188 and 492, SEQ ID NOs: 189 and 493. Exemplary multi-hairpin amiRNA sequences for inhibition of human CTLA-4 are SEQ ID NO: 759-762.

A preferred embodiment comprises a polynucleotide comprising a multi-hairpin amiRNA targeting CTLA-4, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting CTLA-4 comprises two hairpins, each hairpin comprising a different sequence of at least 19 contiguous bases that are complementary to CTLA-4 mRNA and each hairpin operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting CTLA-4, wherein said polynucleotide is part of a transposon. The transposon comprises transposon ends, such that when the transposon is introduced into an immune cell and the immune cell expresses a corresponding transposase, the multi-hairpin amiRNA targeting CTLA-4 is integrated into the genome of the immune cell. An immune cell modified by a transposon-borne multi-hairpin amiRNA targeting CTLA-4 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the CTLA-4 mRNA may have permanently reduced or eliminated activity of the CTLA-4 gene. Optionally the multi-hairpin amiRNA comprising two guide sequences complementary to two different sequences within the CTLA-4 mRNA is operably linked to the same promoter as a gene encoding a chimeric antigen receptor. Reduction of CTLA-4 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the CTLA-4 mRNA may have an improved ability to kill tumor cells.

5.8.6 PD-1 and CTLA-4

Programmed cell death protein 1 (PD-1) is an immune checkpoint with role in down-regulating the immune system, AND cytotoxic T-lymphocyte protein 4 (CTLA-4) is a protein receptor that functions as an immune checkpoint to down-regulate the immune system. Treatment of T-cells with siRNAs directed against both PD-1 and CTLA-4 has improved in vitro CAR-T-cell functionality (Simon et al, 2018. Exp Dermatol. 27:769-778. "The siRNA-mediated downregulation of PD-1 alone or simultaneously with CTLA-4 shows enhanced in vitro CAR-T-cell functionality for further clinical development towards the potential use in immunotherapy of melanoma"). It is therefore advantageous to inhibit expression of both these genes in T-cells simultaneously, using multi-hairpin amiRNAs.

An advantageous gene transfer polynucleotide for inhibition of PD-1 and CTLA-4 in human immune cells comprises a multi-hairpin amiRNA sequence with guides complementary to mRNAs for both. The PD-1/CTLA-4-inhibiting multi-hairpin amiRNA sequence comprises a first guide sequence comprising a contiguous 19 nucleotide sequence complementary to the sequence of the human PD-1 mRNA (SEQ ID NO: 28), and a first passenger sequence comprising a contiguous 19 nucleotide sequence that is at least 78% identical to the reverse complement of the first guide sequence. The PD-1/CTLA-4-inhibiting multi-hairpin amiRNA sequence further comprises a second guide sequence comprising a contiguous 19 nucleotide sequence complementary to SEQ ID NO: 28 and a second passenger sequence comprising a contiguous 19 nucleotide sequence that is at least 78% identical to the reverse complement of the second guide sequence, and wherein the first and second guide sequences are different from each other. The PD-1/CTLA-4-inhibiting multi-hairpin amiRNA sequence further comprises a third guide sequence comprising a contiguous 19 nucleotide sequence complementary to the sequence of the human CTLA-4 mRNA (SEQ ID NO: 30), and a third passenger sequence comprising a contiguous 19 nucleotide sequence that is at least 78% identical to the reverse complement of the third guide sequence. The PD-1/CTLA-4-inhibiting multi-hairpin amiRNA sequence further comprises a fourth guide sequence comprising a contiguous 19 nucleotide sequence complementary to SEQ ID NO: 30 and a fourth passenger sequence comprising a contiguous 19 nucleotide sequence that is at least 78% identical to the reverse complement of the second guide sequence, and wherein the third and fourth guide sequences are different from each other. Each guide sequence is separated from its respective passenger sequence by between 5 and 35 bases. The hairpins may occur in any order in the inhibitory gene transfer polynucleotide. For example, the two hairpins comprising guides complementary to PD-1 may be adjacent to each other, or they may be separated from one another by one or more hairpins comprising guides complementary to CTLA-4. Conversely the two hairpins comprising guides complementary to CTLA-4 may be adjacent to each other, or they may be separated from one another by one or more hairpins comprising guides complementary to PD-1. Exemplary multi-hairpin amiRNA sequences for inhibition of human PD-1 and CTLA-4 are SEQ ID NOs: 763-766. Other exemplary multi-hairpin amiRNA sequences for inhibition of PD-1 and CTLA-4 may be obtained by selecting a sequence from SEQ ID NOs: 755-758, and a sequence from SEQ ID NOs: 759-762 and joining the two sequences together. The order of the two sequences does not matter.

A preferred embodiment comprises a polynucleotide comprising a multi-hairpin amiRNA targeting PD-1 and CTLA-4, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting PD-1 and CTLA-4 comprises four hairpins, each hairpin comprising a different sequence of at least 19 contiguous bases, two of which are complementary to PD-1 mRNA and two of which are complementary to CTLA-4 mRNA and each hairpin operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting PD-1 and CTLA-4, wherein said polynucleotide is part of a transposon. The transposon comprises transposon ends, such that when the transposon is introduced into an immune cell and the immune cell expresses a corresponding transposase, the multi-hairpin amiRNA targeting PD-1 and CTLA-4 is integrated into the genome of the immune cell. An immune cell modified by a transposon-borne multi-hairpin amiRNA targeting PD-1 and CTLA-4 comprises four hairpins, each hairpin comprising a different sequence of at least 19 contiguous bases, two of which are complementary to PD-1 mRNA and two of which are complementary to CTLA-4 mRNA and each hairpin operably linked to a heterologous promoter that is active in a human immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising four guide sequences complementary to two different sequences within the PD-1 mRNA and two different sequences within the CTLA-4 mRNA may have permanently reduced or eliminated activity of the PD-1 and CTLA-4 genes. Optionally the multi-hairpin amiRNA comprising four guide sequences complementary to two different sequences within the PD-1 mRNA and two different sequences within the CTLA-4 mRNA is operably linked to the same promoter as a gene encoding a chimeric antigen receptor. Reduction of PD-1 and CTLA-4 expression may alleviate the phenotype of exhaustion of tumor-infiltrating lymphocytes.

5.8.7 TIM-3

T-cell immunoglobulin mucin receptor 3 (Tim-3, Hepatitis A virus cellular receptor 2) is a co-inhibitory receptor on T-cells. Exhausted T-cells express high levels of Tim-3 (Jiang et. al., 2015. Cell Death & Disease 6, e1972 world wide web doi.org/10.1038/cddis.2015.162. "T-cell exhaustion in the tumor microenvironment"). Tim-3 suppression can enhance T-cell anti-tumor activity (Das et. al., 2017. Immunol Rev. 276, 97-111. "Tim-3 and its role in regulating anti-tumor immunity"). It is therefore advantageous to inhibit expression of this gene in T-cells, using multi-hairpin amiRNAs.

An advantageous gene transfer polynucleotide for inhibition of TIM-3 in human immune cells comprises a TIM-3-inhibiting multi-hairpin amiRNA sequence. The TIM-3-inhibiting multi-hairpin amiRNA sequence comprises a first guide sequence comprising a contiguous 19 nucleotide sequence complementary to the sequence of the human TIM-3 mRNA (SEQ ID NO: 32), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the TIM-3 mRNA that is to the 3' of the open reading frame (SEQ ID NO: 33). The TIM-3-inhibiting multi-hairpin amiRNA sequence further comprises a second guide sequence comprising a contiguous 19 nucleotide sequence complementary to SEQ ID NO: 32 and a second passenger sequence comprising a contiguous 19 nucleotide sequence that is at least 78% identical to the reverse complement of the second guide sequence, and wherein the first and second guide sequences are different from each other. The TIM-3-inhibiting multi-hairpin amiRNA sequence may optionally comprise a third guide sequence comprising a contiguous 19 nucleotide sequence complementary to SEQ ID NO: 32 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting TIM-3 in human immune cells and their respective passenger sequences are SEQ ID NOs: 190 and 494, SEQ ID NOs: 191 and 495, SEQ ID NOs: 192 and 496, SEQ ID NOs: 193 and 497, SEQ ID NOs: 194 and 498, SEQ ID NOs: 195 and 499, SEQ ID NOs: 196 and 500, SEQ ID NOs: 197 and 501, SEQ ID NOs: 198 and 502, and SEQ ID NOs: 199 and 503. Exemplary multi-hairpin amiRNA sequences for inhibition of human TIM-3 are SEQ ID NO: 767-770.

A preferred embodiment comprises a polynucleotide comprising a multi-hairpin amiRNA targeting TIM-3, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting TIM-3 comprises two hairpins, each hairpin comprising a different sequence of at least 19 contiguous bases that are complementary to TIM-3 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting TIM-3, wherein said polynucleotide is part of a transposon. The transposon comprises transposon ends, such that when the transposon is introduced into an immune cell and the immune cell expresses a corresponding transposase, the multi-hairpin amiRNA targeting TIM-3 is integrated into the genome of the immune cell. An immune cell modified by a transposon-borne multi-hairpin amiRNA targeting TIM-3 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the TIM-3 mRNA may have permanently reduced or eliminated activity of the TIM-3 gene. Optionally the multi-hairpin amiRNA comprising two guide sequences complementary to two different sequences within the TIM-3 mRNA is operably linked to the same promoter as a gene encoding a chimeric antigen receptor. Reduction of TIM-3 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the TIM-3 mRNA may have an improved ability to kill tumor cells.

5.8.8 NR4A1 (Nur77)

Nuclear receptor 4A1 (Nur77) has been implicated in inhibiting T-cell function in solid tumors (Rao et al 2019.

Nature 567, 530-534 "NR4A transcription factors limit CAR T cell function in solid tumours."). It is therefore advantageous to inhibit expression of this gene in T-cells, using multi-hairpin amiRNAs.

An advantageous gene transfer polynucleotide for inhibition of NUR77 in human immune cells comprises a NUR77-inhibiting multi-hairpin amiRNA sequence. The NUR77-inhibiting multi-hairpin amiRNA sequence comprises a first guide sequence comprising a contiguous 19 nucleotide sequence complementary to the sequence of the human NUR77 mRNA (SEQ ID NO: 34), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the NUR77 mRNA that is to the 3' of the open reading frame (SEQ ID NO: 35). The NUR77-inhibiting multi-hairpin amiRNA sequence further comprises a second guide sequence comprising a contiguous 19 nucleotide sequence complementary to SEQ ID NO: 34 and a second passenger sequence comprising a contiguous 19 nucleotide sequence that is at least 78% identical to the reverse complement of the second guide sequence, and wherein the first and second guide sequences are different from each other. The NUR77-inhibiting multi-hairpin amiRNA sequence may optionally comprise a third guide sequence comprising a contiguous 19 nucleotide sequence complementary to SEQ ID NO: 34 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting NUR77 in human immune cells and their respective passenger sequences are SEQ ID NOs: 200 and 504, SEQ ID NOs: 201 and 505, SEQ ID NOs: 202 and 506, SEQ ID NOs: 203 and 507, SEQ ID NOs: 204 and 508, SEQ ID NOs: 205 and 509, SEQ ID NOs: 206 and 510, SEQ ID NOs: 207 and 511, SEQ ID NOs: 208 and 512. Exemplary multi-hairpin amiRNA sequences for inhibition of human NUR77 are SEQ ID NO: 771-774.

A preferred embodiment comprises a polynucleotide comprising a multi-hairpin amiRNA targeting NUR77, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting NUR77 comprises two hairpins, each hairpin comprising a different sequence of at least 19 contiguous bases that are complementary to NUR77 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting NUR77, wherein said polynucleotide is part of a transposon. The transposon comprises transposon ends, such that when the transposon is introduced into an immune cell and the immune cell expresses a corresponding transposase, the multi-hairpin amiRNA targeting NUR77 is integrated into the genome of the immune cell. An immune cell modified by a transposon-borne multi-hairpin amiRNA targeting NUR77 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the NUR77 mRNA may have permanently reduced or eliminated activity of the NUR77 gene. Optionally the multi-hairpin amiRNA comprising two guide sequences complementary to two different sequences within the NUR77 mRNA is operably linked to the same promoter as a gene encoding a chimeric antigen receptor. Reduction of NUR77 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the Nur77 mRNA may have an improved ability to kill tumor cells.

5.8.9 NR4A2 (Nurr1)

Nuclear receptor 4A2 (Nurr1) has been implicated in inhibiting T-cell function in solid tumors (Rao et al 2019. Nature 567, 530-534 "NR4A transcription factors limit CAR T cell function in solid tumours."). It is therefore advantageous to inhibit expression of this gene in T-cells, using multi-hairpin amiRNAs.

An advantageous gene transfer polynucleotide for inhibition of NURR1 in human immune cells comprises a NURR1-inhibiting multi-hairpin amiRNA sequence. The NURR1-inhibiting multi-hairpin amiRNA sequence comprises a first guide sequence comprising a contiguous 19 nucleotide sequence complementary to the sequence of the human NURR1 mRNA (SEQ ID NO: 36), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the NURR1 mRNA that is to the 3' of the open reading frame (SEQ ID NO: 37). The NURR1-inhibiting multi-hairpin amiRNA sequence further comprises a second guide sequence comprising a contiguous 19 nucleotide sequence complementary to SEQ ID NO: 36 and a second passenger sequence comprising a contiguous 19 nucleotide sequence that is at least 78% identical to the reverse complement of the second guide sequence, and wherein the first and second guide sequences are different from each other. The NURR1-inhibiting multi-hairpin amiRNA sequence may optionally comprise a third guide sequence comprising a contiguous 19 nucleotide sequence complementary to SEQ ID NO: 36 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting NURR1 in human immune cells and their respective passenger sequences are SEQ ID NOs: 209 and 513, SEQ ID NOs: 210 and 514, SEQ ID NOs: 211 and 515, SEQ ID NOs: 212 and 516, SEQ ID NOs: 213 and 517, SEQ ID NOs: 214 and 518, SEQ ID NOs: 215 and 519, SEQ ID NOs: 216 and 520. Exemplary multi-hairpin amiRNA sequences for inhibition of human NURR1 are SEQ ID NO: 775-778.

A preferred embodiment comprises a polynucleotide comprising a multi-hairpin amiRNA targeting NURR1, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting NURR1 comprises two hairpins, each hairpin comprising a different sequence of at least 19 contiguous bases that are complementary to NURR1 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting NURR1, wherein said polynucleotide is part of a transposon. The transposon comprises transposon ends, such that when the transposon is introduced into an immune cell and the immune cell expresses a corresponding transposase, the multi-hairpin amiRNA targeting NURR1 is integrated into the genome of the immune cell. An immune cell modified by a transposon-borne multi-hairpin amiRNA targeting NURR1 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the NURR1 mRNA may have permanently reduced or eliminated activity of the NURR1 gene. Optionally the multi-hairpin amiRNA comprising two guide sequences complementary to two different sequences within the NURR1 mRNA is operably linked to the same promoter as a gene encoding a chimeric antigen receptor. Reduction of NURR1 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the NUUR1 mRNA may have an improved ability to kill tumor cells.

5.8.10 NR4A3 (NOR1)

Nuclear receptor 4A3 (NOR1) has been implicated in inhibiting T-cell function in solid tumors (Rao et al 2019. Nature 567, 530-534 "NR4A transcription factors limit CAR T cell function in solid tumours."). It is therefore advantageous to inhibit expression of this gene in T-cells, using multi-hairpin amiRNAs.

An advantageous gene transfer polynucleotide for inhibition of NOR1 in human immune cells comprises a NOR1-inhibiting multi-hairpin amiRNA sequence. The NOR1-inhibiting multi-hairpin amiRNA sequence comprises a first guide sequence comprising a contiguous 19 nucleotide sequence complementary to the sequence of the human NOR1 mRNA (SEQ ID NO: 38), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the NOR1 mRNA that is to the 3' of the open reading frame (SEQ ID NO: 39). The NOR1-inhibiting multi-hairpin amiRNA sequence further comprises a second guide sequence comprising a contiguous 19 nucleotide sequence complementary to SEQ ID NO: 38 and a second passenger sequence comprising a contiguous 19 nucleotide sequence that is at least 78% identical to the reverse complement of the second guide sequence, and wherein the first and second guide sequences are different from each other. The NOR1-inhibiting multi-hairpin amiRNA sequence may optionally comprise a third guide sequence comprising a contiguous 19 nucleotide sequence complementary to SEQ ID NO: 38 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting NOR1 in human immune cells and their respective passenger sequences are SEQ ID NOs: 217 and 521, SEQ ID NOs: 218 and 522, SEQ ID NOs: 219 and 523, SEQ ID NOs: 220 and 524, SEQ ID NOs: 221 and 525, SEQ ID NOs: 222 and 526, SEQ ID NOs: 223 and 527, SEQ ID NOs: 224 and 528, and SEQ ID NOs: 225 and 529. Exemplary multi-hairpin amiRNA sequences for inhibition of human NOR1 are SEQ ID NOs: 779-782.

A preferred embodiment comprises a polynucleotide comprising a multi-hairpin amiRNA targeting NOR1, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting NOR1 comprises two hairpins, each hairpin comprising a different sequence of at least 19 contiguous bases that are complementary to NOR1 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting NOR1, wherein said polynucleotide is part of a transposon. The transposon comprises transposon ends, such that when the transposon is introduced into an immune cell and the immune cell expresses a corresponding transposase, the multi-hairpin amiRNA targeting NOR1 is integrated into the genome of the immune cell. An immune cell modified by a transposon-borne multi-hairpin amiRNA targeting NOR1 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the NOR1 mRNA may have permanently reduced or eliminated activity of the NOR1 gene. Optionally the multi-hairpin amiRNA comprising two guide sequences complementary to two different sequences within the NOR1 mRNA is operably linked to the same promoter as a gene encoding a chimeric antigen receptor. Reduction of NOR1 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the NOR1 mRNA may have an improved ability to kill tumor cells.

5.8.11 NR4A1 (Nur77) AND NR4A2 (Nurr1) AND NR4A3 (NOR1)

Nuclear receptor 4A1, 2 and 3 (Nur77, Nuur1 and NOR1) may be involved together in inhibiting T-cell function in solid tumors (Rao et al 2019. Nature 567, 530-534 "NR4A transcription factors limit CAR T cell function in solid tumours."). It is therefore advantageous to inhibit expression of both these genes in T-cells simultaneously, using multi-hairpin amiRNAs.

An advantageous gene transfer polynucleotide for inhibition of Nur77, NOR1 and Nuur1 in human immune cells comprises a multi-hairpin amiRNA sequence with guides complementary to mRNAs for all three genes. The Nur77/NOR1/Nuur1-inhibiting multi-hairpin amiRNA sequence comprises a first guide sequence comprising a contiguous 19 nucleotide sequence complementary to the sequence of the human Nur77 mRNA (SEQ ID NO: 34), and a first passenger sequence comprising a contiguous 19 nucleotide sequence that is at least 78% identical to the reverse complement of the first guide sequence. The Nur77/NOR1/Nuur1-inhibiting multi-hairpin amiRNA sequence further comprises a second guide sequence comprising a contiguous 19 nucleotide sequence complementary to SEQ ID NO: 34 and a second passenger sequence comprising a contiguous 19 nucleotide sequence that is at least 78% identical to the reverse complement of the second guide sequence, and wherein the first and second guide sequences are different from each other. The Nur77/NOR1/Nuur1-inhibiting multi-hairpin amiRNA sequence further comprises a third guide sequence comprising a contiguous 19 nucleotide sequence complementary to the sequence of the human Nuur1 mRNA (SEQ ID NO: 36), and a third passenger sequence comprising a contiguous 19 nucleotide sequence that is at least 78% identical to the reverse complement of the third guide sequence. The Nur77/Nuur1-inhibiting multi-hairpin amiRNA sequence further comprises a fourth guide sequence comprising a contiguous 19 nucleotide sequence complementary to SEQ ID NO: 36 and a fourth passenger sequence comprising a contiguous 19 nucleotide sequence that is at least 78% identical to the reverse complement of the fourth guide sequence, and wherein the third and fourth guide sequences are different from each other. The Nur77/NOR1/Nuur1-inhibiting multi-hairpin amiRNA sequence further comprises a fifth guide sequence comprising a contiguous 19 nucleotide sequence complementary to the sequence of the human NOR1 mRNA (SEQ ID NO: 38), and a fifth passenger sequence comprising a contiguous 19 nucleotide sequence that is at least 78% identical to the reverse complement of the fifth guide sequence. The Nur77/NOR1/Nuur1-inhibiting multi-hairpin amiRNA sequence further comprises a sixth guide sequence comprising a contiguous 19 nucleotide sequence complementary to SEQ ID NO: 38 and a sixth passenger sequence comprising a contiguous 19 nucleotide sequence that is at least 78% identical to the reverse complement of the sixth guide sequence, and wherein the fifth and sixth guide sequences are different from each other. Each guide sequence is separated from its respective passenger sequence by between 5 and 35 bases. The hairpins may occur in any order in the inhibitory gene transfer polynucleotide. For example, the two hairpins comprising guides complementary to Nur77 may be adjacent to each other, or they may be separated from one another by one or more hairpins comprising guides complementary to Nuur1 or NOR1. Exemplary multi-hairpin amiRNA sequences for inhibition of human Nur77 and Nuur1 and NOR1 are SEQ ID NOs: 783-788. Other exemplary multi-hairpin amiRNA sequences for inhibition of Nur77 and Nuur1 and NOR1 may be obtained by selecting a sequence selected from SEQ ID NOs: 771-774, and a sequence selected from SEQ ID NOs: 775-778, and a sequence selected from SEQ ID NOs: 779-782 and joining the three sequences together. The order of the three sequences does not matter.

A preferred embodiment comprises a polynucleotide comprising a multi-hairpin amiRNA targeting Nur77, NOR1 and Nuur1, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting Nur77, NOR1 and Nuur1 comprises six hairpins, each hairpin comprising a different sequence of at least 19 contiguous bases, two of which are complementary to Nur77 mRNA, two of which are complementary to NOR1 mRNA and two of which are complementary to Nuur1 mRNA and each hairpin is operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting Nur77 and Nuur1, wherein said polynucleotide is part of a transposon. The transposon comprises transposon ends, such that when the transposon is introduced into an immune cell and the immune cell expresses a corresponding transposase, the multi-hairpin amiRNA targeting Nur77, NOR1 and Nuur1 is integrated into the genome of the immune cell. An immune cell modified by a transposon-borne multi-hairpin amiRNA targeting Nur77, NOR1 and Nuur1 comprises six hairpins, each hairpin comprising a different sequence of at least 19 contiguous bases, two of which are complementary to Nur77 mRNA, two of which are complementary to NOR1 mRNA and two of which are complementary to Nuur1 mRNA and each hairpin is operably linked to a heterologous promoter that is active in a human immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising six guide sequences six guide sequences, wherein two guide sequences are complementary to two different sequences within the Nur77 mRNA, two guide sequences are complementary to two different sequences within the Nuur1 mRNA, and two guide sequences are complementary to two different sequences within the NOR1 mRNA may have permanently reduced or eliminated activity of the Nur77, NOR1 and Nuur1 genes. Optionally the multi-hairpin amiRNA comprising six guide sequences six guide sequences, wherein two guide sequences are complementary to two different sequences within the Nur77 mRNA, two guide sequences are complementary to two different sequences within the Nuur1 mRNA, and two guide sequences are complementary to two different sequences within the NOR1 mRNA is operably linked to the same promoter as a gene encoding a chimeric antigen receptor. Reduction of Nur77 and Nuur1 expression may alleviate the phenotype of exhaustion of tumor-infiltrating lymphocytes.

5.8.9 NFAT

The transcription factor nuclear factor of activated T-cells (NFAT) has been implicated in promoting exhaustion of CD8 T-cells (Martinez et al., 2015. Immunity 42, 265-278. "The transcription factor NFAT promotes exhaustion of activated CD8+ T cells"). It is therefore advantageous to inhibit expression of this gene in T-cells, using multi-hairpin amiRNAs.

An advantageous gene transfer polynucleotide for inhibition of NFAT in human immune cells comprises a NFAT-inhibiting multi-hairpin amiRNA sequence. The NFAT-inhibiting multi-hairpin amiRNA sequence comprises a first guide sequence comprising a contiguous 19 nucleotide sequence complementary to the sequence of the human NFAT mRNA (SEQ ID NO: 40), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the NFAT mRNA that is to the 3' of the open reading frame (SEQ ID NO: 41). The NFAT-inhibiting multi-hairpin amiRNA sequence further comprises a second guide sequence comprising a contiguous 19 nucleotide sequence complementary to SEQ ID NO: 40 and a second passenger sequence comprising a contiguous 19 nucleotide sequence that is at least 78% identical to the reverse complement of the second guide sequence, and wherein the first and second guide sequences are different from each other. The NFAT-inhibiting multi-hairpin amiRNA sequence may optionally comprise a third guide sequence comprising a contiguous 19 nucleotide sequence complementary to SEQ ID NO: 40 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting NFAT in human immune cells and their respective passenger sequences are SEQ ID NOs: 226 and 530, SEQ ID NOs: 227 and 531, SEQ ID NOs: 228 and 532, SEQ ID NOs: 229 and 533, SEQ ID NOs: 230 and 534, SEQ ID NOs: 231 and 535, SEQ ID NOs: 232 and 536, SEQ ID NOs: 233 and 537, SEQ ID NOs: 234 and 538, SEQ ID NOs: 235 and 539, and SEQ ID NOs: 236 and 540. Exemplary multi-hairpin amiRNA sequences for inhibition of human NFAT are SEQ ID NOs: 789-792.

A preferred embodiment comprises a polynucleotide comprising a multi-hairpin amiRNA targeting NFAT, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting NFAT comprises two hairpins, each hairpin comprising a different sequence of at least 19 contiguous bases that are complementary to NFAT mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting NFAT, wherein said polynucleotide is part of a transposon. The transposon comprises transposon ends, such that when the transposon is introduced into an immune cell and the immune cell expresses a corresponding transposase, the multi-hairpin amiRNA targeting NFAT is integrated into the genome of the immune cell. An immune cell modified by a transposon-borne multi-hairpin amiRNA targeting NFAT comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the NFAT mRNA may have permanently reduced or eliminated activity of the NFAT gene. Optionally the multi-hairpin amiRNA comprising two guide sequences complementary to two different sequences within the NFAT mRNA is operably linked to the same promoter as a gene encoding a chimeric antigen receptor. Reduction of NFAT expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the NFAT mRNA may have an improved ability to kill tumor cells.

5.8.12 FAS (CD95)

Antigen-independent tonic signaling by chimeric antigen receptors (CARs) can increase differentiation and exhaustion of T cells, limiting their potency. Incorporating 4-1BB costimulation in CARs may enable T cells to resist this functional exhaustion. This tonic CAR-derived 4-1BB signaling can produce toxicity in T cells via augmented FAS-dependent cell death (Gomes-Silva et. al., 2017. Cell Rep. 21, 17-26. "Tonic 4-1BB Costimulation in Chimeric Antigen Receptors Impedes T Cell Survival and Is Vector Dependent"). It is therefore advantageous to inhibit expression of FAS in T-cells, using multi-hairpin amiRNAs.

An advantageous gene transfer polynucleotide for inhibition of FAS in human immune cells comprises a FAS-inhibiting multi-hairpin amiRNA sequence. The FAS-inhibiting multi-hairpin amiRNA sequence comprises a first guide sequence comprising a contiguous 19 nucleotide sequence complementary to the sequence of the human FAS mRNA (SEQ ID NO: 42), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the FAS mRNA that is to the 3' of the open reading frame (SEQ ID NO: 43). The FAS-inhibiting multi-hairpin amiRNA sequence further comprises a second guide sequence comprising a contiguous 19 nucleotide sequence complementary to SEQ ID NO: 42 and a second passenger sequence comprising a contiguous 19 nucleotide sequence that is at least 78% identical to the reverse complement of the second guide sequence, and wherein the first and second guide sequences are different from each other. The FAS-inhibiting multi-hairpin amiRNA sequence may optionally comprise a third guide sequence comprising a contiguous 19 nucleotide sequence complementary to SEQ ID NO: 42 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting FAS in human immune cells and their respective passenger sequences are SEQ ID NOs: 237 and 541, SEQ ID NOs: 238 and 542, SEQ ID NOs: 239 and 543, SEQ ID NOs: 240 and 544, SEQ ID NOs: 241 and 545, SEQ ID NOs: 242 and 546, SEQ ID NOs: 243 and 547, SEQ ID NOs: 244 and 548. Exemplary multi-hairpin amiRNA sequences for inhibition of human FAS are SEQ ID NO: 793-796.

A preferred embodiment comprises a polynucleotide comprising a multi-hairpin amiRNA targeting FAS, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting FAS comprises two hairpins, each hairpin comprising a different sequence of at least 19 contiguous bases that are complementary to FAS mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting FAS, wherein said polynucleotide is part of a transposon. The transposon comprises transposon ends, such that when the transposon is introduced into an immune cell and the immune cell expresses a corresponding transposase, the multi-hairpin amiRNA targeting FAS is integrated into the genome of the immune cell. An immune cell modified by a transposon-borne multi-hairpin amiRNA targeting FAS comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the FAS mRNA may have permanently reduced or eliminated activity of the FAS gene. Optionally the multi-hairpin amiRNA comprising two guide sequences complementary to two different sequences within the FAS mRNA is operably linked to the same promoter as a gene encoding a chimeric antigen receptor. Reduction of FAS expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the FAS mRNA may have an improved ability to kill tumor cells.

5.8.13 Caspase 3

Caspase 3 expression is activated during induction of anergy in T-cells. Blocking Caspase 3 expression using siRNA impairs the induction of anergy. It is therefore advantageous to inhibit expression of caspase 3 in T-cells, using multi-hairpin amiRNAs.

An advantageous gene transfer polynucleotide for inhibition of caspase 3 in human immune cells comprises a caspase 3-inhibiting multi-hairpin amiRNA sequence. The caspase 3-inhibiting multi-hairpin amiRNA sequence comprises a first guide sequence comprising a contiguous 19 nucleotide sequence complementary to the sequence of the human caspase 3 mRNA (SEQ ID NO: 44), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the caspase 3 mRNA that is to the 3' of the open reading frame (SEQ ID NO: 45). The caspase 3-inhibiting multi-hairpin amiRNA sequence further comprises a second guide sequence comprising a contiguous 19 nucleotide sequence complementary to SEQ ID NO: 44 and a second passenger sequence comprising a contiguous 19 nucleotide sequence that is at least 78% identical to the reverse complement of the second guide sequence, and wherein the first and second guide sequences are different from each other. The caspase 3-inhibiting multi-hairpin amiRNA sequence may optionally comprise a third guide sequence comprising a contiguous 19 nucleotide sequence complementary to SEQ ID NO: 44 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting caspase 3 in human immune cells and their respective passenger sequences are SEQ ID NOs: 245 and 549, SEQ ID NOs: 246 and 550, SEQ ID NOs: 247 and 551, SEQ ID NOs: 248 and 552, SEQ ID NOs: 249 and 553, SEQ ID NOs: 250 and 554, SEQ ID NOs: 251 and 555, SEQ ID NOs: 252 and 556. Exemplary multi-hairpin amiRNA sequences for inhibition of human caspase 3 are SEQ ID NOs: 797-800.

A preferred embodiment comprises a polynucleotide comprising a multi-hairpin amiRNA targeting caspase 3, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting caspase 3 comprises two hairpins, each hairpin comprising a different sequence of at least 19 contiguous bases that are complementary to caspase 3 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting caspase 3, wherein said polynucleotide is part of a transposon. The transposon comprises transposon ends, such that when the transposon is introduced into an immune cell and the immune cell expresses a corresponding transposase, the multi-hairpin amiRNA targeting caspase 3 is integrated into the genome of the immune cell. An immune cell modified by a transposon-borne multi-hairpin amiRNA targeting caspase 3 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the caspase 3 mRNA may have permanently reduced or eliminated activity of the caspase 3 gene. Optionally the multi-hairpin amiRNA comprising two guide sequences complementary to two different sequences within the caspase 3 mRNA is operably linked to the same promoter as a gene encoding a chimeric antigen receptor. Reduction of caspase 3 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the caspase 3 mRNA may have an improved ability to kill tumor cells.

5.8.14 Caspase 7

Mice lacking the caspase 7 gene are protected from endotoxin-induced lymphocyte apoptosis (Lamkanfi et. at. 2009. Blood 113, 2742-2745. "Caspase-7 deficiency protects from endotoxin-induced lymphocyte apoptosis and improves survival"). Decreasing lymphocyte apoptosis may be advantageous in many immune cell therapies. It is therefore advantageous to inhibit expression of caspase 7 in T-cells, using multi-hairpin amiRNAs.

An advantageous gene transfer polynucleotide for inhibition of caspase 7 in human immune cells comprises a caspase 7-inhibiting multi-hairpin amiRNA sequence. The caspase 7-inhibiting multi-hairpin amiRNA sequence comprises a first guide sequence comprising a contiguous 19 nucleotide sequence complementary to the sequence of the human caspase 7 mRNA (SEQ ID NO: 46), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the caspase 7 mRNA that is to the 3' of the open reading frame (SEQ ID NO: 47). The caspase 7-inhibiting multi-hairpin amiRNA sequence further comprises a second guide sequence comprising a contiguous 19 nucleotide sequence complementary to SEQ ID NO: 46 and a second passenger sequence comprising a contiguous 19 nucleotide sequence that is at least 78% identical to the reverse complement of the second guide sequence, and wherein the first and second guide sequences are different from each other. The caspase 7-inhibiting multi-hairpin amiRNA sequence may optionally comprise a third guide sequence comprising a contiguous 19 nucleotide sequence complementary to SEQ ID NO: 46 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting caspase 7 in human immune cells and their respective passenger sequences are SEQ ID NOs: 253 and 557, SEQ ID NOs: 254 and 558, SEQ ID NOs: 255 and 559, SEQ ID NOs: 256 and 560, SEQ ID NOs: 257 and 561, SEQ ID NOs: 258 and 562, SEQ ID NOs: 259 and 563, SEQ ID NOs: 260 and 564. Exemplary multi-hairpin amiRNA sequences for inhibition of human caspase 7 are SEQ ID NOs: 801-804.

A preferred embodiment comprises a polynucleotide comprising a multi-hairpin amiRNA targeting caspase 7, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting caspase 7 comprises two hairpins, each hairpin comprising a different sequence of at least 19 contiguous bases that are complementary to caspase 7 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting caspase 7, wherein said polynucleotide is part of a transposon. The transposon comprises transposon ends, such that when the transposon is introduced into an immune cell and the immune cell expresses a corresponding transposase, the multi-hairpin amiRNA targeting caspase 7 is integrated into the genome of the immune cell. An immune cell modified by a transposon-borne multi-hairpin amiRNA targeting caspase 7 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon.

The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the caspase 7 mRNA may have permanently reduced or eliminated activity of the caspase 7 gene. Optionally the multi-hairpin amiRNA comprising two guide sequences complementary to two different sequences within the caspase 7 mRNA is operably linked to the same promoter as a gene encoding a chimeric antigen receptor. Reduction of caspase 7 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the caspase 7 mRNA may have an improved ability to kill tumor cells.

5.8.15 Caspase 8

Fas and other T-cell inhibitory receptors act through the caspase 8 gene (Murali et. al., 2011. J. Clin. Cell Immunol. Suppl 3: 2. doi:10.4172/2155-9899.S3-002. "Apoptosis—an Ubiquitous T cell Immunomodulator"). Decreasing lymphocyte apoptosis may be advantageous in many immune cell therapies. It is therefore advantageous to inhibit expression of caspase 8 in T-cells, using multi-hairpin amiRNAs.

An advantageous gene transfer polynucleotide for inhibition of caspase 8 in human immune cells comprises a caspase 8-inhibiting multi-hairpin amiRNA sequence. The caspase 8-inhibiting multi-hairpin amiRNA sequence comprises a first guide sequence comprising a contiguous 19 nucleotide sequence complementary to the sequence of the human caspase 8 mRNA (SEQ ID NO: 48), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the caspase 8 mRNA that is to the 3' of the open reading frame (SEQ ID NO: 49). The caspase 8-inhibiting multi-hairpin amiRNA sequence further comprises a second guide sequence comprising a contiguous 19 nucleotide sequence complementary to SEQ ID NO: 48 and a second passenger sequence comprising a contiguous 19 nucleotide sequence that is at least 78% identical to the reverse complement of the second guide sequence, and wherein the first and second guide sequences are different from each other. The caspase 8-inhibiting multi-hairpin amiRNA sequence may optionally comprise a third guide sequence comprising a contiguous 19 nucleotide sequence complementary to SEQ ID NO: 48 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting caspase 8 in human immune cells and their respective passenger sequences are SEQ ID NOs: 261 and 565, SEQ ID NOs: 262 and 566, SEQ ID NOs: 263 and 567, SEQ ID NOs: 264 and 568, SEQ ID NOs: 265 and 569, SEQ ID NOs: 266 and 570, SEQ ID NOs: 267 and 571, SEQ ID NOs: 268 and 572, SEQ ID NOs: 269 and 573. Exemplary multi-hairpin amiRNA sequences for inhibition of human caspase 8 are SEQ ID NOs: 805-808.

A preferred embodiment comprises a polynucleotide comprising a multi-hairpin amiRNA targeting caspase 8, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting caspase 8 comprises two hairpins, each hairpin comprising a different sequence of at least 19 contiguous bases that are complementary to caspase 8 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting caspase 8, wherein said polynucleotide is part of a transposon. The transposon comprises transposon ends, such that when the transposon is introduced into an immune cell and the immune cell expresses a corresponding transposase, the multi-hairpin amiRNA targeting caspase 8 is integrated into the genome of the immune cell. An immune cell modified by a transposon-borne multi-hairpin amiRNA targeting caspase 8 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the caspase 8 mRNA may have permanently reduced or eliminated activity of the caspase 8 gene. Optionally the multi-hairpin amiRNA comprising two guide sequences complementary to two different sequences within the caspase 8 mRNA is operably linked to the same promoter as a gene encoding a chimeric antigen receptor. Reduction of caspase 8 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the caspase 8 mRNA may have an improved ability to kill tumor cells.

5.8.16 Caspase 9

By blocking caspase activation, signals that would normally elicit a tolerogenic response can be converted to immunogenic signals (Murali et. al., 2011. J. Clin. Cell Immunol. Suppl 3: 2. doi:10.4172/2155-9899.S3-002. "Apoptosis—an Ubiquitous T cell Immunomodulator"). Decreasing lymphocyte apoptosis may be advantageous in many immune cell therapies. It is therefore advantageous to inhibit expression of caspase 9 in T-cells, using multi-hairpin amiRNAs.

An advantageous gene transfer polynucleotide for inhibition of caspase 9 in human immune cells comprises a caspase 9-inhibiting multi-hairpin amiRNA sequence. The caspase 9-inhibiting multi-hairpin amiRNA sequence comprises a first guide sequence comprising a contiguous 19 nucleotide sequence complementary to the sequence of the human caspase 9 mRNA (SEQ ID NO: 50), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the caspase 9 mRNA that is to the 3' of the open reading frame (SEQ ID NO: 51). The caspase 9-inhibiting multi-hairpin amiRNA sequence further comprises a second guide sequence comprising a contiguous 19 nucleotide sequence complementary to SEQ ID NO: 50 and a second passenger sequence comprising a contiguous 19 nucleotide sequence that is at least 78% identical to the reverse complement of the second guide sequence, and wherein the first and second guide sequences are different from each other. The caspase 9-inhibiting multi-hairpin amiRNA sequence may optionally comprise a third guide sequence comprising a contiguous 19 nucleotide sequence complementary to SEQ ID NO: 50 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting caspase 9 in human immune cells and their respective passenger sequences are SEQ ID NOs: 270 and 574, SEQ ID NOs: 271 and 575, SEQ ID NOs: 272 and 576, SEQ ID NOs: 273 and 577, SEQ ID NOs: 274 and 578, SEQ ID NOs: 275 and 579, SEQ ID NOs: 276 and 580, SEQ ID NOs: 277 and 581, SEQ ID NOs: 278 and 582. Exemplary multi-hairpin amiRNA sequences for inhibition of human caspase 9 are SEQ ID NOs: 809-812.

A preferred embodiment comprises a polynucleotide comprising a multi-hairpin amiRNA targeting caspase 9, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting caspase 9 comprises two hairpins, each hairpin comprising a different sequence of at least 19 contiguous bases that are complementary to caspase 9 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting caspase 9, wherein said polynucleotide is part of a transposon. The transposon comprises transposon ends, such that when the transposon is introduced into an immune cell and the immune cell expresses a corresponding transposase, the multi-hairpin amiRNA targeting caspase 9 is integrated into the genome of the immune cell. An immune cell modified by a transposon-borne multi-hairpin amiRNA targeting caspase 9 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the caspase 9 mRNA may have permanently reduced or eliminated activity of the caspase 9 gene. Optionally the multi-hairpin amiRNA comprising two guide sequences complementary to two different sequences within the caspase 9 mRNA is operably linked to the same promoter as a gene encoding a chimeric antigen receptor. Reduction of caspase 9 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the caspase 9 mRNA may have an improved ability to kill tumor cells.

5.8.17 Caspase 10

By blocking caspase activation, signals that would normally elicit a tolerogenic response can be converted to immunogenic signals (Murali et. al., 2011. J. Clin. Cell Immunol. Suppl 3: 2. doi:10.4172/2155-9899.S3-002. "Apoptosis—an Ubiquitous T cell Immunomodulator"). Decreasing lymphocyte apoptosis may be advantageous in many immune cell therapies. It is therefore advantageous to inhibit expression of caspase 10 in T-cells, using multi-hairpin amiRNAs.

An advantageous gene transfer polynucleotide for inhibition of caspase 10 in human immune cells comprises a caspase 10-inhibiting multi-hairpin amiRNA sequence. The caspase 10-inhibiting multi-hairpin amiRNA sequence comprises a first guide sequence comprising a contiguous 19 nucleotide sequence complementary to the sequence of the human caspase 10 mRNA (SEQ ID NO: 52), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the caspase 10 mRNA that is to the 3' of the open reading frame (SEQ ID NO: 53). The caspase 10-inhibiting multi-hairpin amiRNA sequence further comprises a second guide sequence comprising a contiguous 19 nucleotide sequence complementary to SEQ ID NO: 52 and a second passenger sequence comprising a contiguous 19 nucleotide sequence that is at least 78% identical to the reverse complement of the second guide sequence, and wherein the first and second guide sequences are different from each other. The caspase 10-inhibiting multi-hairpin amiRNA sequence may optionally comprise a third guide sequence comprising a contiguous 19 nucleotide sequence complementary to SEQ ID NO: 52 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting caspase 10 in human immune cells and their respective passenger sequences are SEQ ID NOs: 279 and 583, SEQ ID NOs: 280 and 584, SEQ ID NOs: 281 and 585, SEQ ID NOs: 282 and 586, SEQ ID NOs: 283 and 587, SEQ ID NOs: 284 and 588, SEQ ID NOs: 285 and 589, and SEQ ID NOs: 286 and 590. Exemplary multi-hairpin amiRNA sequences for inhibition of human caspase 10 are SEQ ID NOs: 813-816.

A preferred embodiment comprises a polynucleotide comprising a multi-hairpin amiRNA targeting caspase 10, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting caspase 10 comprises two hairpins, each hairpin comprising a different sequence of at least 19 contiguous bases that are complementary to caspase 10 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting caspase 10, wherein said polynucleotide is part of a transposon. The transposon comprises transposon ends, such that when the transposon is introduced into an immune cell and the immune cell expresses a corresponding transposase, the multi-hairpin amiRNA targeting caspase 10 is integrated into the genome of the immune cell. An immune cell modified by a transposon-borne multi-hairpin amiRNA targeting caspase 10 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the caspase 10 mRNA may have permanently reduced or eliminated activity of the caspase 10 gene. Optionally the multi-hairpin amiRNA comprising two guide sequences complementary to two different sequences within the caspase 10 mRNA is operably linked to the same promoter as a gene encoding a chimeric antigen receptor. Reduction of caspase 10 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the caspase 10 mRNA may have an improved ability to kill tumor cells.

5.8.18 Death Receptor 4 (TNFRSF10A)

Different tumors may use different methods to evade the immune system. For example, colorectal cancers may induce death receptor signaling by expressing the TRAIL ligand, which stimulates TRAIL receptor 1 (death receptor 4, tumor necrosis factor receptor superfamily member 10A (TNFRSF10A)) leading to T-cell apoptosis (Murali et. al., 2011. J. Clin. Cell Immunol. Suppl 3: 2. doi:10.4172/2155- 9899.S3-002. "Apoptosis—an Ubiquitous T cell Immunomodulator"). It is therefore advantageous to inhibit expression of death receptor 4 in T-cells, using multi-hairpin amiRNAs.

An advantageous gene transfer polynucleotide for inhibition of death receptor 4 in human immune cells comprises a death receptor 4-inhibiting multi-hairpin amiRNA sequence. The death receptor 4-inhibiting multi-hairpin amiRNA sequence comprises a first guide sequence comprising a contiguous 19 nucleotide sequence complementary to the sequence of the human death receptor 4 mRNA (SEQ ID NO: 54), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the death receptor 4 mRNA that is to the 3' of the open reading frame (SEQ ID NO: 55). The death receptor 4-inhibiting multi-hairpin amiRNA sequence further comprises a second guide sequence comprising a contiguous 19 nucleotide sequence complementary to SEQ ID NO: 54 and a second passenger sequence comprising a contiguous 19 nucleotide sequence that is at least 78% identical to the reverse complement of the second guide sequence, and wherein the first and second guide sequences are different from each other. The death receptor 4-inhibiting multi-hairpin amiRNA sequence may optionally comprise a third guide sequence comprising a contiguous 19 nucleotide sequence complementary to SEQ ID NO: 54 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting death receptor 4 in human immune cells and their respective passenger sequences are SEQ ID NOs: 287 and 591, SEQ ID NOs: 288 and 592, SEQ ID NOs: 289 and 593, SEQ ID NOs: 290 and 594, SEQ ID NOs: 291 and 595, SEQ ID NOs: 292 and 596, SEQ ID NOs: 293 and 597, SEQ ID NOs: 294 and 598. Exemplary multi-hairpin amiRNA sequences for inhibition of human death receptor 4 are SEQ ID NOs: 817-820.

A preferred embodiment comprises a polynucleotide comprising a multi-hairpin amiRNA targeting death receptor 4, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting death receptor 4 comprises two hairpins, each hairpin comprising a different sequence of at least 19 contiguous bases that are complementary to death receptor 4 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting death receptor 4, wherein said polynucleotide is part of a transposon. The transposon comprises transposon ends, such that when the transposon is introduced into an immune cell and the immune cell expresses a corresponding transposase, the multi-hairpin amiRNA targeting death receptor 4 is integrated into the genome of the immune cell. An immune cell modified by a transposon-borne multi-hairpin amiRNA targeting death receptor 4 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the death receptor 4 mRNA may have permanently reduced or eliminated activity of the death receptor 4 gene. Optionally the multi-hairpin amiRNA comprising two guide sequences complementary to two different sequences within the death receptor 4 mRNA is operably linked to the same promoter as a gene encoding a chimeric antigen receptor. Reduction of death receptor 4 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the death receptor 4 mRNA may have an improved ability to kill tumor cells.

5.8.19 Death Receptor 5 (TNFRSF10B)

Different tumors may use different methods to evade the immune system. For example, colorectal cancers may induce death receptor signaling by expressing the TRAIL ligand, which stimulates TRAIL receptor 2 (death receptor 5, tumor necrosis factor receptor superfamily member 10A (TNFRSF10B)) leading to T-cell apoptosis (Murali et. al., 2011. J. Clin. Cell Immunol. Suppl 3: 2. doi:10.4172/2155-9899.S3-002. "Apoptosis—an Ubiquitous T cell Immunomodulator"). It is therefore advantageous to inhibit expression of death receptor 5 in T-cells, using multi-hairpin amiRNAs.

An advantageous gene transfer polynucleotide for inhibition of death receptor 5 in human immune cells comprises a death receptor 5-inhibiting multi-hairpin amiRNA sequence. The death receptor 5-inhibiting multi-hairpin amiRNA sequence comprises a first guide sequence comprising a contiguous 19 nucleotide sequence complementary to the sequence of the human death receptor 5 mRNA (SEQ ID NO: 56), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the death receptor 5 mRNA that is to the 3' of the open reading frame (SEQ ID NO: 57). The death receptor 5-inhibiting multi-hairpin amiRNA sequence further comprises a second guide sequence comprising a contiguous 19 nucleotide sequence complementary to SEQ ID NO: 56 and a second passenger sequence comprising a contiguous 19 nucleotide sequence that is at least 78% identical to the reverse complement of the second guide sequence, and wherein the first and second guide sequences are different from each other. The death receptor 5-inhibiting multi-hairpin amiRNA sequence may optionally comprise a third guide sequence comprising a contiguous 19 nucleotide sequence complementary to SEQ ID NO: 56 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting death receptor 5 in human immune cells and their respective passenger sequences are SEQ ID NOs: 295 and 599, SEQ ID NOs: 296 and 600, SEQ ID NOs: 297 and 601, SEQ ID NOs: 298 and 602, SEQ ID NOs: 299 and 603, SEQ ID NOs: 300 and 604, SEQ ID NOs: 301 and 605, SEQ ID NOs: 302 and 606, SEQ ID NOs: 303 and 607. Exemplary multi-hairpin amiRNA sequences for inhibition of human death receptor 5 are SEQ ID NOs: 821-824.

A preferred embodiment comprises a polynucleotide comprising a multi-hairpin amiRNA targeting death receptor 5, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting death receptor 5 comprises two hairpins, each hairpin comprising a different sequence of at least 19 contiguous bases that are complementary to death receptor 5 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting death receptor 5, wherein said polynucleotide is part of a transposon. The transposon comprises transposon ends, such that when the transposon is introduced into an immune cell and the immune cell expresses a corresponding transposase, the multi-hairpin amiRNA targeting death receptor 5 is integrated into the genome of the immune cell. An immune cell modified by a transposon-borne multi-hairpin amiRNA targeting death receptor 5 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the death receptor 5 mRNA may have permanently reduced or eliminated activity of the death receptor 5 gene. Optionally the multi-hairpin amiRNA comprising two guide sequences complementary to two different sequences within the death receptor 5 mRNA is operably linked to the same promoter as a gene encoding a chimeric antigen receptor. Reduction of death receptor 5 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the death receptor 5 mRNA may have an improved ability to kill tumor cells.

5.8.20 Death Receptors 4 and 5

Different tumors may use different methods to evade the immune system. For example, colorectal cancers may induce death receptor signaling by expressing the TRAIL ligand, which stimulates death receptors 4 and 5, leading to T-cell apoptosis (Murali et. al., 2011. J. Clin. Cell Immunol. Suppl 3: 2. doi:10.4172/2155-9899.S3-002. "Apoptosis—an Ubiquitous T cell Immunomodulator"). It is therefore advantageous to inhibit expression of death receptors 4 and 5 in T-cells, using multi-hairpin amiRNAs.

An advantageous gene transfer polynucleotide for inhibition of death receptor 4 and death receptor 5 in human immune cells comprises a multi-hairpin amiRNA sequence with guides complementary to mRNAs for both. The death receptor 4/death receptor 5-inhibiting multi-hairpin amiRNA sequence comprises a first guide sequence comprising a contiguous 19 nucleotide sequence complementary to the sequence of the human death receptor 4 mRNA (SEQ ID NO: 54), and a first passenger sequence comprising a contiguous 19 nucleotide sequence that is at least 78% identical to the reverse complement of the first guide sequence. The death receptor 4/death receptor 5-inhibiting multi-hairpin amiRNA sequence further comprises a second guide sequence comprising a contiguous 19 nucleotide sequence complementary to SEQ ID NO: 54 and a second passenger sequence comprising a contiguous 19 nucleotide sequence that is at least 78% identical to the reverse complement of the second guide sequence, and wherein the first and second guide sequences are different from each other. The death receptor 4/death receptor 5-inhibiting multi-hairpin amiRNA sequence further comprises a third guide sequence comprising a contiguous 19 nucleotide sequence complementary to the sequence of the human death receptor 5 mRNA (SEQ ID NO: 56), and a third passenger sequence comprising a contiguous 19 nucleotide sequence that is at least 78% identical to the reverse complement of the third guide sequence. The death receptor 4/death receptor 5-inhibiting multi-hairpin amiRNA sequence further comprises a fourth guide sequence comprising a contiguous 19 nucleotide sequence complementary to SEQ ID NO: 56 and a fourth passenger sequence comprising a contiguous 19 nucleotide sequence that is at least 78% identical to the reverse complement of the second guide sequence, and wherein the third and fourth guide sequences are different from each other. Each guide sequence is separated from its respective passenger sequence by between 5 and 35 bases. The hairpins may occur in any order in the inhibitory gene transfer polynucleotide. For example, the two hairpins comprising guides complementary to death receptor 4 may be adjacent to each other, or they may be separated from one another by one or more hairpins comprising guides complementary to death receptor 5. Conversely the two hairpins comprising guides complementary to death receptor 5 may be adjacent to each other, or they may be separated from one another by one or more hairpins comprising guides complementary to death receptor 4. Exemplary multi-hairpin amiRNA sequences for inhibition of human death receptor 4 and death receptor 5 are SEQ ID NOs: 825-826. Other exemplary multi-hairpin amiRNA sequences for inhibition of human death receptor 4 and death receptor 5 may be obtained by selecting a sequence from SEQ ID NOs: 817-820, and a sequence from SEQ ID NOs: 821-824 and joining the two sequences together. The order of the two sequences does not matter.

A preferred embodiment comprises a polynucleotide comprising a multi-hairpin amiRNA targeting death receptor 4 and death receptor 5, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting death receptor 4 and death receptor 5 comprises four hairpins, each hairpin comprising a different sequence of at least 19 contiguous bases, two of which are complementary to death receptor 4 mRNA and two of which are complementary to death receptor 5 mRNA and each hairpin operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting death receptor 4 and death receptor 5, wherein said polynucleotide is part of a transposon. The transposon comprises transposon ends, such that when the transposon is introduced into an immune cell and the immune cell expresses a corresponding transposase, the multi-hairpin amiRNA targeting death receptor 4 and death receptor 5 is integrated into the genome of the immune cell. An immune cell modified by a transposon-borne multi-hairpin amiRNA targeting death receptor 4 and death receptor 5 comprises four hairpins, each hairpin comprising a different sequence of at least 19 contiguous bases, two of which are complementary to death receptor 4 mRNA and two of which are complementary to death receptor 5 mRNA and each hairpin operably linked to a heterologous promoter that is active in a human immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising four guide sequences complementary to two different sequences within the death receptor 4 mRNA and two different sequences within the death receptor 5 mRNA may have permanently reduced or eliminated activity of the death receptor 4 and death receptor 5 genes. Optionally the multi-hairpin amiRNA comprising four guide sequences complementary to two different sequences within the death receptor 4 mRNA and two different sequences within the death receptor 5 mRNA is operably linked to the same promoter as a gene encoding a chimeric antigen receptor. Reduction of death receptor 4 and death receptor 5 expression may alleviate the phenotype of exhaustion of tumor-infiltrating lymphocytes.

5.8.21 Apaf1

T-cells from mice lacking apoptotic peptidase activating factor 1 (Apaf1) proliferated more efficiently and showed higher percentages of cells with activation phenotypes (Tong et. al. 2018 PLOS ONE, world wide web doi.org/10.1371/journal.pone.0195119. "Apaf1 plays a negative regulatory role in T cell responses by suppressing activation of antigen-stimulated T cells"). It is therefore advantageous to inhibit expression of Apaf1 in Tcells, using multi-hairpin amiRNAs.

An advantageous gene transfer polynucleotide for inhibition of Apaf1 in human immune cells comprises a Apaf1-inhibiting multi-hairpin amiRNA sequence. The Apaf1-inhibiting multi-hairpin amiRNA sequence comprises a first guide sequence comprising a contiguous 19 nucleotide sequence complementary to the sequence of the human Apaf1 mRNA (SEQ ID NO: 58), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the Apaf1 mRNA that is to the 3' of the open reading frame (SEQ ID NO: 59). The Apaf1-inhibiting multi-hairpin amiRNA sequence further comprises a second guide sequence comprising a contiguous 19 nucleotide sequence complementary to SEQ ID NO: 58 and a second passenger sequence comprising a contiguous 19 nucleotide sequence that is at least 78% identical to the reverse complement of the second guide sequence, and wherein the first and second guide sequences are different from each other. The Apaf1-inhibiting multi-hairpin amiRNA sequence may optionally comprise a third guide sequence comprising a contiguous 19 nucleotide sequence complementary to SEQ ID NO: 58 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting Apaf1 in human immune cells and their respective passenger sequences are SEQ ID NOs: 304 and 608, SEQ ID NOs: 305 and 609, SEQ ID NOs: 306 and 610, SEQ ID NOs: 307 and 611, SEQ ID NOs: 308 and 612, SEQ ID NOs: 309 and 613, SEQ ID NOs: 310 and 614, SEQ ID NOs: 311 and 615, SEQ ID NOs: 312 and 616, and SEQ ID NOs: 313 and 617. Exemplary multi-hairpin amiRNA sequences for inhibition of human Apaf1 are SEQ ID NOs: 827-832.

A preferred embodiment comprises a polynucleotide comprising a multi-hairpin amiRNA targeting Apaf1, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting Apaf1 comprises two hairpins, each hairpin comprising a different sequence of at least 19 contiguous bases that are complementary to Apaf1 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting Apaf1, wherein said polynucleotide is part of a transposon. The transposon comprises transposon ends, such that when the transposon is introduced into an immune cell and the immune cell expresses a corresponding transposase, the multi-hairpin amiRNA targeting Apaf1 is integrated into the genome of the immune cell. An immune cell modified by a transposon-borne multi-hairpin amiRNA targeting Apaf1 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the Apaf1 mRNA may have permanently reduced or eliminated activity of the Apaf1 gene. Optionally the multi-hairpin amiRNA comprising two guide sequences complementary to two different sequences within the Apaf1 mRNA is operably linked to the same promoter as a gene encoding a chimeric antigen receptor. Reduction of Apaf1 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the Apaf1 mRNA may have an improved ability to kill tumor cells.

5.8.22 Blimp1

B lymphocyte-induced maturation protein-I (Blimp-I) expression correlates with T-cell exhaustion during chronic viral infections (Fu et. al., 2017. J. Biomedical Science 24, 49 world wide web doi.org/10.1 186/s12929-01 7-0354-8. "New insights into Blimp-I in T lymphocytes: a divergent regulator of cell destiny and effector function") and cancer (Zhu et. al., 2017. J. Hematology and Oncology 10: 124 world wide web doi.org/10.1 186/s13045-01 7-0486-z. "Blimp-I impairs T cell function via upregulation of TIGIT and PD-1 in patients with acute myeloid leukemia"). It is therefore advantageous to inhibit expression of Blimp 1 in T-cells, using multi-hairpin amiRNAs.

An advantageous gene transfer polynucleotide for inhibition of Blimp1 in human immune cells comprises a Blimp1-inhibiting multi-hairpin amiRNA sequence. The Blimp1-inhibiting multi-hairpin amiRNA sequence comprises a first guide sequence comprising a contiguous 19 nucleotide sequence complementary to the sequence of the human Blimp1 mRNA (SEQ ID NO: 60), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the Blimp1 mRNA that is to the 3' of the open reading frame (SEQ ID NO: 61). The Blimp1-inhibiting multi-hairpin amiRNA sequence further comprises a second guide sequence comprising a contiguous 19 nucleotide sequence complementary to SEQ ID NO: 60 and a second passenger sequence comprising a contiguous 19 nucleotide sequence that is at least 78% identical to the reverse complement of the second guide sequence, and wherein the first and second guide sequences are different from each other. The Blimp1-inhibiting multi-hairpin amiRNA sequence may optionally comprise a third guide sequence comprising a contiguous 19 nucleotide sequence complementary to SEQ ID NO: 60 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting Blimp1 in human immune cells and their respective passenger sequences are SEQ ID NOs: 314 and 618, SEQ ID NOs: 315 and 619, SEQ ID NOs: 316 and 620, SEQ ID NOs: 317 and 621, SEQ ID NOs: 318 and 622, SEQ ID NOs: 319 and 623, SEQ ID NOs: 320 and 624, SEQ ID NOs: 321 and 625, and SEQ ID NOs: 322 and 626. Exemplary multi-hairpin amiRNA sequences for inhibition of human Blimp1 are SEQ ID NOs: 833-838.

A preferred embodiment comprises a polynucleotide comprising a multi-hairpin amiRNA targeting Blimp1, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting Blimp1 comprises two hairpins, each hairpin comprising a different sequence of at least 19 contiguous bases that are complementary to Blimp1 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting Blimp1, wherein said polynucleotide is part of a transposon. The transposon comprises transposon ends, such that when the transposon is introduced into an immune cell and the immune cell expresses a corresponding transposase, the multi-hairpin amiRNA targeting Blimp1 is integrated into the genome of the immune cell. An immune cell modified by a transposon-borne multi-hairpin amiRNA targeting Blimp1 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the Blimp1 mRNA may have permanently reduced or eliminated activity of the Blimp1 gene. Optionally the multi-hairpin amiRNA comprising two guide sequences complementary to two different sequences within the Blimp1 mRNA is operably linked to the same promoter as a gene encoding a chimeric antigen receptor. Reduction of Blimp1 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the Blimp1 mRNA may have an improved ability to kill tumor cells.

5.8.23 BTLA

Exhausted T-cells express high levels of T lymphocyte attenuator (BTLA) (Jiang et. al., 2015. Cell Death & Disease 6, el 972 world wide web doi.org/10.1038/cddis. 2015.162. "T-cell_exhaustion in the tumor microenvironment"). It is therefore advantageous to inhibit expression of BTLA in T-cells, using multi-hairpin amiRNAs.

An advantageous gene transfer polynucleotide for inhibition of BTLA in human immune cells comprises a BTLA-inhibiting multi-hairpin amiRNA sequence. The BTLA-inhibiting multi-hairpin amiRNA sequence comprises a first guide sequence comprising a contiguous 19 nucleotide sequence complementary to the sequence of the human BTLA mRNA (e.g. SEQ ID NO: 62), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the BTLA mRNA that is to the 3' of the open reading frame (e.g. SEQ ID NO: 63). The BTLA-inhibiting multi-hairpin amiRNA sequence further comprises a second guide sequence comprising a contiguous 19 nucleotide sequence complementary to SEQ ID NO: 62 and a second passenger sequence comprising a contiguous 19 nucleotide sequence that is at least 78% identical to the reverse complement of the second guide sequence, and wherein the first and second guide sequences are different from each other. The BTLA-inhibiting multi-hairpin amiRNA sequence may optionally comprise a third guide sequence comprising a contiguous 19 nucleotide sequence complementary to SEQ ID NO: 62 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting BTLA in human immune cells and their respective passenger sequences are SEQ ID NOs: 323 and 627, SEQ ID NOs: 324 and 628, SEQ ID NOs: 325 and 629, SEQ ID NOs: 326 and 630, SEQ ID NOs: 327 and 631, SEQ ID NOs: 328 and 632, SEQ ID NOs: 329 and 633, and SEQ ID NOs: 330 and 634. Exemplary multi-hairpin amiRNA sequences for inhibition of human BTLA are SEQ ID Nos: 839-844.

A preferred embodiment comprises a polynucleotide comprising a multi-hairpin amiRNA targeting BTLA, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting BTLA comprises two hairpins, each hairpin comprising a different sequence of at least 19 contiguous bases that are complementary to BTLA mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting BTLA, wherein said polynucleotide is part of a transposon. The transposon comprises transposon ends, such that when the transposon is introduced into an immune cell and the immune cell expresses a corresponding transposase, the multi-hairpin amiRNA targeting BTLA is integrated into the genome of the immune cell. An immune cell modified by a transposon-borne multi-hairpin amiRNA targeting BTLA comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon.

The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the BTLA mRNA may have permanently reduced or eliminated activity of the BTLA gene. Optionally the multi-hairpin amiRNA comprising two guide sequences complementary to two different sequences within the BTLA mRNA is operably linked to the same promoter as a gene encoding a chimeric antigen receptor. Reduction of BTLA expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the BTLA mRNA may have an improved ability to kill tumor cells.

5.8.21 LAG-3

Exhausted T-cells express high levels of Lymphocyte activation gene 3 protein (Lag-3) (Jiang et. al., 2015. Cell Death & Disease 6, e1972 world wide web doi org/10.1038/cddis.2015.162. "T-cell exhaustion in the tumor microenvironment"). It is therefore advantageous to inhibit expression of Lag-3 in T-cells, using multi-hairpin amiRNAs.

An advantageous gene transfer polynucleotide for inhibition of LAG-3 in human immune cells comprises a LAG-3-inhibiting multi-hairpin amiRNA sequence. The LAG-3-inhibiting multi-hairpin amiRNA sequence comprises a first guide sequence comprising a contiguous 19 nucleotide sequence complementary to the sequence of the human LAG-3 mRNA (e.g. SEQ ID NO: 64), and a first passenger sequence comprising a contiguous 19 nucleotide sequence that is at least 78% identical to the reverse complement of the first guide sequence. The LAG-3-inhibiting multi-hairpin amiRNA sequence further comprises a second guide sequence comprising a contiguous 19 nucleotide sequence complementary to SEQ ID NO: 64 and a second passenger sequence comprising a contiguous 19 nucleotide sequence that is at least 78% identical to the reverse complement of the second guide sequence, and wherein the first and second guide sequences are different from each other. The LAG-3-inhibiting multi-hairpin amiRNA sequence may optionally comprise a third guide sequence comprising a contiguous 19 nucleotide sequence complementary to SEQ ID NO: 64 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting LAG-3 in human immune cells and their respective passenger sequences are SEQ ID NOs: 331 and 635, SEQ ID NOs: 332 and 636, SEQ ID NOs: 333 and 637, SEQ ID NOs: 334 and 638, SEQ ID NOs: 335 and 639, SEQ ID NOs: 336 and 640, SEQ ID NOs: 337 and 641, and SEQ ID NOs: 338 and 642. Exemplary multi-hairpin amiRNA sequences for inhibition of human LAG-3 are SEQ ID NOs: 845-850.

A preferred embodiment comprises a polynucleotide comprising a multi-hairpin amiRNA targeting LAG-3, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting LAG-3 comprises two hairpins, each hairpin comprising a different sequence of at least 19 contiguous bases that are complementary to LAG-3 mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting LAG-3, wherein said polynucleotide is part of a transposon. The transposon comprises transposon ends, such that when the transposon is introduced into an immune cell and the immune cell expresses a corresponding transposase, the multi-hairpin amiRNA targeting LAG-3 is integrated into the genome of the immune cell. An immune cell modified by a transposon-borne multi-hairpin amiRNA targeting LAG-3 comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the LAG-3 mRNA may have permanently reduced or eliminated activity of the LAG-3 gene. Optionally the multi-hairpin amiRNA comprising two guide sequences complementary to two different sequences within the LAG-3 mRNA is operably linked to the same promoter as a gene encoding a chimeric antigen receptor. Reduction of LAG-3 expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the LAG-3 mRNA may have an improved ability to kill tumor cells.

5.8.22 TIGIT

Exhausted T-cells express high levels off-cell immunoreceptor with lg and ITIM domains (TIGIT) (Jiang et. al., 2015. Cell Death & Disease 6, e1972 world wide web doi.org/10.1038/cddis.2015.162. "T-cell exhaustion in the tumor microenvironment"). It is therefore advantageous to inhibit expression off IGIT in T-cells, using multi-hairpin amiRNAs.

An advantageous gene transfer polynucleotide for inhibition of TIGIT in human immune cells comprises a TIGIT-inhibiting multi-hairpin amiRNA sequence. The TIGIT-inhibiting multi-hairpin amiRNA sequence comprises a first guide sequence comprising a contiguous 19 nucleotide sequence complementary to the sequence of the human TIGIT mRNA (e.g. SEQ ID NO: 65), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the TIGIT mRNA that is to the 3' of the open reading frame (e.g. SEQ ID NO: 66).

The TIGIT-inhibiting multi-hairpin amiRNA sequence further comprises a second guide sequence comprising a contiguous 19 nucleotide sequence complementary to SEQ ID NO: 65 and a second passenger sequence comprising a contiguous 19 nucleotide sequence that is at least 78% identical to the reverse complement of the second guide sequence, and wherein the first and second guide sequences are different from each other. The TIGIT-inhibiting multi-hairpin amiRNA sequence may optionally comprise a third guide sequence comprising a contiguous 19 nucleotide sequence complementary to SEQ ID NO: 65 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting TIGIT in human immune cells and their respective passenger sequences are SEQ ID NOs: 340 and 644, SEQ ID NOs: 341 and 645, SEQ ID NOs: 342 and 646, SEQ ID NOs: 343 and 647, SEQ ID NOs: 344 and 648, SEQ ID NOs: 345 and 649, and SEQ ID NOs: 346 and 650. Exemplary multi-hairpin amiRNA sequences for inhibition of human TIGIT are SEQ ID NOs: 851-856.

A preferred embodiment comprises a polynucleotide comprising a multi-hairpin amiRNA targeting TIGIT, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting TIGIT comprises two hairpins, each hairpin comprising a different sequence of at least 19 contiguous bases that are complementary to TIGIT mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting TIGIT, wherein said polynucleotide is part of a transposon. The transposon comprises transposon ends, such that when the transposon is introduced into an immune cell and the immune cell expresses a corresponding transposase, the multi-hairpin amiRNA targeting TIGIT is integrated into the genome of the immune cell. An immune cell modified by a transposon-borne multi-hairpin amiRNA targeting TIGIT comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the TIGIT mRNA may have permanently reduced or eliminated activity of the TIGIT gene. Optionally the multi-hairpin amiRNA comprising two guide sequences complementary to two different sequences within the TIGIT mRNA is operably linked to the same promoter as a gene encoding a chimeric antigen receptor. Reduction of TIGIT expression may alleviate the phenotype of exhaustion of tumor-infiltrating lymphocytes. A T-cell whose genome comprises an inhibitory polynucleotide comprising a multi-hairpin amiRNA comprising two guide sequences complementary to two different sequences within the TIGIR mRNA may have an improved ability to kill tumor cells.

5.8.26 Beta-2-microglobulin

A limitation for adoptive T-cell transfer is that the functionality of a patient's own T-cells may have been compromised by previous treatments, making it difficult to proliferate the cells in vitro. In addition, the logistics of extracting a patient's own T-cells, modifying them and returning them to the patient can be a significant logistical hurdle. An alternative is to eliminate major histocompatibility complex expression from T-cells from an unmatched donor, for example by knocking out beta-2-microglobulin. This will prevent the adoptively transferred T-cells from being cleared by the patient's own immune response. This deletion may be effected using CRISPR/Cas9 (Ren et. al., 2017. Clin. Cancer Res. 23: 2255-2266. "Multiplex genome editing to generate universal CAR T cells resistant to PD1 inhibition"). Alternatively, inhibition of expression of beta-2-microglobulin can be achieved using multi-hairpin amiRNAs.

An advantageous gene transfer polynucleotide for inhibition of beta-2-microglobulin in human immune cells comprises a beta-2-microglobulin-inhibiting multi-hairpin amiRNA sequence. The beta-2-microglobulin-inhibiting multi-hairpin amiRNA sequence comprises a first guide sequence comprising a contiguous 19 nucleotide sequence complementary to the sequence of the human beta-2-microglobulin mRNA (e.g. SEQ ID NO: 67), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the beta-2-microglobulin mRNA that is to the 3' of the open reading frame (e.g. SEQ ID NO: 68). The beta-2-microglobulin-inhibiting multi-hairpin amiRNA sequence further comprises a second guide sequence comprising a contiguous 19 nucleotide sequence complementary to SEQ ID NO: 67 and a second passenger sequence comprising a contiguous 19 nucleotide sequence that is at least 78% identical to the reverse complement of the second guide sequence, and wherein the first and second guide sequences are different from each other. The beta-2-microglobulin-inhibiting multi-hairpin amiRNA sequence may optionally comprise a third guide sequence comprising a contiguous 19 nucleotide sequence complementary to SEQ ID NO: 67 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting beta-2-microglobulin in human immune cells and their respective passenger sequences are SEQ ID NOs: 347 and 651, SEQ ID NOs: 348 and 652, SEQ ID NOs: 349 and 653, SEQ ID NOs: 350 and 654, SEQ ID NOs: 351 and 655, SEQ ID NOs: 352 and 656, SEQ ID NOs: 353 and 657, and SEQ ID NOs: 354 and 658. Exemplary multi-hairpin amiRNA sequences for inhibition of human beta-2-microglobulin are SEQ ID NOs: 857-862.

A preferred embodiment comprises a polynucleotide comprising a multi-hairpin amiRNA targeting beta-2-microglobulin, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell, or a B-cell. An immune cell modified by a lentiviral-borne multi-hairpin amiRNA targeting beta-2-microglobulin comprises two hairpins, each hairpin comprising a different sequence of at least 19 contiguous bases that are complementary to beta-2-microglobulin mRNA and each hairpin operably linked to a heterologous promoter that is active in a mammalian immune cell, wherein the hairpins and the promoter are flanked by the inverted terminal repeats of a lentivirus.

A preferred embodiment comprises a polynucleotide comprising a multi-hairpin amiRNA targeting beta-2-microglobulin, wherein said polynucleotide is part of a transposon. The transposon comprises transposon ends, such that when the transposon is introduced into an immune cell and the immune cell expresses a corresponding transposase, the multi-hairpin amiRNA targeting beta-2-microglobulin is integrated into the genome of the immune cell. An immune cell modified by a transposon-borne multi-hairpin amiRNA targeting beta-2-microglobulin comprises two hairpins, each hairpin comprising a different sequence of at least 19 contiguous bases that are complementary to the target mRNA and each hairpin operably linked to a heterologous promoter that is active in a mammalian immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell, or a B-cell.

An immune cell whose genome comprises an inhibitory polynucleotide comprising a multi-hairpin amiRNA comprising two guide sequences complementary to two different sequences within the beta-2-microglobulin mRNA may have permanently reduced or eliminated activity of the beta-2-microglobulin gene. Such an immune cell would have reduced or eliminated immunogenicity, and would thus have a reduced risk of rejection by a patient who receives the immune cell. Optionally the multi-hairpin amiRNA comprising two guide sequences complementary to two different sequences within the beta-2-microglobulin mRNA is operably linked to the same promoter as a gene encoding a chimeric antigen receptor.

5.8.27 T-Cell Receptor

Adoptive transfer of T-cells from an unmatched donor has two major potential pitfalls. The first is that engrafted T-cells will be targets for the host immune system. This problem can be abrogated by deletion of beta-2-microglobulin. The second issue is that the engrafted T-cells may recognize and destroy the unmatched host. This occurrence may be avoided by preventing expression of the T-cell receptor. This may be effected using CRISPR/Cas9 (Ren et. al., 2017. Clin. Cancer Res. 23: 2255-2266. "Multiplex genome editing to generate universal CAR T cells resistant to PD1 inhibition"). Alternatively, inhibition of expression of the T-cell receptor can be achieved using multi-hairpin amiRNAs to target the alpha, beta1 and beta2 constant regions (TCR alpha, TCR beta1 and TCR beta2 respectively).

An advantageous gene transfer polynucleotide for inhibition of TCR alpha in human immune cells comprises a TCR alpha-inhibiting multi-hairpin amiRNA sequence. The TCR alpha-inhibiting multi-hairpin amiRNA sequence comprises a first guide sequence comprising a contiguous 19 nucleotide sequence complementary to the sequence of the constant region of human TCR alpha mRNA (SEQ ID NO: 69), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the TCR alpha mRNA that is to the 3' of the open reading frame (SEQ ID NO: 70). The TCR alpha-inhibiting multi-hairpin amiRNA sequence further comprises a second guide sequence comprising a contiguous 19 nucleotide sequence complementary to SEQ ID NO: 69 and a second passenger sequence comprising a contiguous 19 nucleotide sequence that is at least 78% identical to the reverse complement of the second guide sequence, and wherein the first and second guide sequences are different from each other. The TCR alpha-inhibiting multi-hairpin amiRNA sequence may optionally comprise a third guide sequence comprising a contiguous 19 nucleotide sequence complementary to SEQ ID NO: 69 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting TCR alpha in human immune cells and their respective passenger sequences are SEQ ID NOs: 355 and 659, SEQ ID NOs: 356 and 660, SEQ ID NOs: 357 and 661, SEQ ID NOs: 358 and 662, SEQ ID NOs: 359 and 663, SEQ ID NOs: 360 and 664, SEQ ID NOs: 361 and 665, and SEQ ID NOs: 362 and 666.

An advantageous gene transfer polynucleotide for inhibition of TCR beta1 in human immune cells comprises a TCR beta1-inhibiting multi-hairpin amiRNA sequence. The TCR beta1-inhibiting multi-hairpin amiRNA sequence comprises a first guide sequence comprising a contiguous 19 nucleotide sequence complementary to the sequence of the constant region of human TCR beta1 mRNA (SEQ ID NO: 71), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the TCR beta1 mRNA that is to the 3' of the open reading frame (SEQ ID NO: 72). The TCR beta1-inhibiting multi-hairpin amiRNA sequence further comprises a second guide sequence comprising a contiguous 19 nucleotide sequence complementary to SEQ ID NO: 71 and a second passenger sequence comprising a contiguous 19 nucleotide sequence that is at least 78% identical to the reverse complement of the second guide sequence, and wherein the first and second guide sequences are different from each other. The TCR beta1-inhibiting multi-hairpin amiRNA sequence may optionally comprise a third guide sequence comprising a contiguous 19 nucleotide sequence complementary to SEQ ID NO: 71 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting TCR beta1 in human immune cells and their respective passenger sequences are SEQ ID NOs: 363 and 667, SEQ ID NOs: 364 and 668, SEQ ID NOs: 365 and 669, SEQ ID NOs: 366 and 670, SEQ ID NOs: 367 and 671, SEQ ID NOs: 368 and 672, SEQ ID NOs: 369 and 673, and SEQ ID NOs: 370 and 674.

An advantageous gene transfer polynucleotide for inhibition of TCR beta2 in human immune cells comprises a TCR beta2-inhibiting multi-hairpin amiRNA sequence. The TCR beta2-inhibiting multi-hairpin amiRNA sequence comprises a first guide sequence comprising a contiguous 19 nucleotide sequence complementary to the sequence of the constant region of human TCR beta2 mRNA (SEQ ID NO: 73), and a first passenger sequence comprising a contiguous 19 nucleotide sequence that is at least 78% identical to the reverse complement of the first guide sequence. More preferably the first guide sequence comprises a contiguous 19 nucleotide sequence complementary to the sequence of the TCR beta2 mRNA that is to the 3' of the open reading frame (SEQ ID NO: 74). The TCR beta2-inhibiting multi-hairpin amiRNA sequence further comprises a second guide sequence comprising a contiguous 19 nucleotide sequence complementary to SEQ ID NO: 73 and a second passenger sequence comprising a contiguous 19 nucleotide sequence that is at least 78% identical to the reverse complement of the second guide sequence, and wherein the first and second guide sequences are different from each other. The TCR beta2-inhibiting multi-hairpin amiRNA sequence may optionally comprise a third guide sequence comprising a contiguous 19 nucleotide sequence complementary to SEQ ID NO: 73 and a third passenger sequence comprising a contiguous 19 nucleotide sequence that is at least 78% identical to the reverse complement of the third guide sequence, and wherein the first, second and third guide sequences are all different from each other. Each guide sequence is separated from its respective passenger sequence by between 5 and 35 bases. Exemplary guide sequences for inhibiting TCR beta2 in human immune cells and their respective passenger sequences are SEQ ID NOs: 371 and 675, SEQ ID NOs: 372 and 676, SEQ ID NOs: 373 and 677, SEQ ID NOs: 374 and 678, SEQ ID NOs: 375 and 679, SEQ ID NOs: 376 and 680, SEQ ID NOs: 377 and 681, and SEQ ID NOs: 378 and 682.

An advantageous gene transfer polynucleotide for inhibition of TCR alpha, TCR beta1 and TCR beta2 in human immune cells comprises a multi-hairpin amiRNA sequence with guides complementary to mRNAs for all three genes. The TCR alpha/TCR beta1/TCR beta2-inhibiting multi-hairpin amiRNA sequence comprises a first guide sequence comprising a contiguous 19 nucleotide sequence complementary to the sequence of the human TCR alpha mRNA (SEQ ID NO: 69), and a first passenger sequence comprising a contiguous 19 nucleotide sequence that is at least 78% identical to the reverse complement of the first guide sequence. The TCR alpha/TCR beta1/TCR beta2-inhibiting multi-hairpin amiRNA sequence further comprises a second guide sequence comprising a contiguous 19 nucleotide sequence complementary to SEQ ID NO: 69 and a second passenger sequence comprising a contiguous 19 nucleotide sequence that is at least 78% identical to the reverse complement of the second guide sequence, and wherein the first and second guide sequences are different from each other. The TCR alpha/TCR beta1/TCR beta2-inhibiting multi-hairpin amiRNA sequence further comprises a third guide sequence comprising a contiguous 19 nucleotide sequence complementary to the sequence of the human TCR beta2 mRNA (SEQ ID NO: 73), and a third passenger sequence comprising a contiguous 19 nucleotide sequence that is at least 78% identical to the reverse complement of the third guide sequence. The TCR alpha/TCR beta2-inhibiting multi-hairpin amiRNA sequence further comprises a fourth guide sequence comprising a contiguous 19 nucleotide sequence complementary to SEQ ID NO: 73 and a fourth passenger sequence comprising a contiguous 19 nucleotide sequence that is at least 78% identical to the reverse complement of the fourth guide sequence, and wherein the third and fourth guide sequences are different from each other. The TCR alpha/TCR beta1/TCR beta2-inhibiting multi-hairpin amiRNA sequence further comprises a fifth guide sequence comprising a contiguous 19 nucleotide sequence complementary to the sequence of the human TCR beta1 mRNA (SEQ ID NO: 71), and a fifth passenger sequence comprising a contiguous 19 nucleotide sequence that is at least 78% identical to the reverse complement of the fifth guide sequence. The TCR alpha/TCR beta1/TCR beta2-inhibiting multi-hairpin amiRNA sequence further comprises a sixth guide sequence comprising a contiguous 19 nucleotide sequence complementary to SEQ ID NO: 71 and a sixth passenger sequence comprising a contiguous 19 nucleotide sequence that is at least 78% identical to the reverse complement of the sixth guide sequence, and wherein the fifth and sixth guide sequences are different from each other. Each guide sequence is separated from its respective passenger sequence by between 5 and 35 bases. The hairpins may occur in any order in the inhibitory gene transfer polynucleotide. For example, the two hairpins comprising guides complementary to TCR alpha may be adjacent to each other, or they may be separated from one another by one or more hairpins comprising guides complementary to TCR beta2 or TCR beta1. Exemplary multi-hairpin amiRNA sequences for inhibition of human TCR alpha and TCR beta2 and TCR beta1 are SEQ ID NOs: 863-868.

A preferred embodiment comprises a polynucleotide comprising a multi-hairpin amiRNA targeting TCR alpha, TCR beta1 and TCR beta2, wherein said polynucleotide is part of a lentiviral vector. The lentiviral vector comprising the multi-hairpin amiRNA may be packaged and used to infect the immune cell. The immune cell is preferably a T-cell (for example a CD4 T-cell, a CD8 T-cell or a natural killer (NK) T-cell. An immune cell modified by a lentiviral-borne multi-hairpin amiRNA targeting TCR alpha, TCR beta1 and TCR beta2 comprises six hairpins, each hairpin comprising a different sequence of at least 19 contiguous bases, two of which are complementary to TCR alpha mRNA, two of which are complementary to TCR beta1 mRNA and two of which are complementary to TCR beta2 mRNA and each hairpin is operably linked to a heterologous promoter that is active in a human immune cell, wherein the hairpins and the promoter are flanked by the inverted terminal repeats of a lentivirus.

A preferred embodiment comprises a polynucleotide comprising a multi-hairpin amiRNA targeting TCR alpha and TCR beta2, wherein said polynucleotide is part of a transposon. The transposon comprises transposon ends, such that when the transposon is introduced into an immune cell and the immune cell expresses a corresponding transposase, the multi-hairpin amiRNA targeting TCR alpha, TCR beta1 and TCR beta2 is integrated into the genome of the immune cell. An immune cell modified by a transposon-borne multi-hairpin amiRNA targeting TCR alpha, TCR beta1 and TCR beta2 comprises six hairpins, each hairpin comprising a different sequence of at least 19 contiguous bases, two of which are complementary to TCR alpha mRNA, two of which are complementary to TCR beta1 mRNA and two of which are complementary to TCR beta2 mRNA and each hairpin is operably linked to a heterologous promoter that is active in a human immune cell, wherein the hairpins and the promoter are flanked by the inverted terminal repeats of a transposon. The transposon may be a piggyBac-like transposon or a Mariner transposon such as a Sleeping Beauty transposon. The immune cell is preferably a T-cell (for example a CD4 T-cell, a CD8 T-cell or a natural killer (NK) T-cell.

An immune cell whose genome comprises an inhibitory polynucleotide comprising a multi-hairpin amiRNA comprising six guide sequences, wherein two guide sequences are complementary to two different sequences within the TCR alpha mRNA, two guide sequences are complementary to two different sequences within the TCR beta1 mRNA, and two guide sequences are complementary to two different sequences within the TCR beta2 mRNA, may have permanently reduced or eliminated activity of the TCR alpha and TCR beta2 genes. Optionally the multi-hairpin amiRNA comprising six guide sequences, wherein two guide sequences are complementary to two different sequences within the TCR alpha mRNA, two guide sequences are complementary to two different sequences within the TCR beta1 mRNA, and two guide sequences are complementary to two different sequences within the TCR beta2 mRNA is operably linked to the same promoter as a gene encoding a chimeric antigen receptor.

5.8.28 Enhanced Survival and Proliferation

Preferably the half-life of immune cells whose genome comprises an inhibitory gene transfer polynucleotide targeting an endogenous immune cell gene is increased by at least 5%, or at least 10%, or at least 15%, or at least 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or at least 100% relative to the half-life of immune cells whose genome does not comprise an inhibitory gene transfer polynucleotide and is expressing the endogenous immune cell gene at normal levels. Preferably the maximum life span of immune cells whose genome comprises an inhibitory gene transfer polynucleotide targeting an endogenous immune cell gene is increased by at least 5%, or at least 10%, or at least 15%, or at least 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or at least 100% relative to the maximum life span of immune cells whose genome does not comprise an inhibitory gene transfer polynucleotide and is expressing the endogenous immune cell gene at normal levels. Preferably the doubling time of immune cells whose genome does not comprise an inhibitory gene transfer polynucleotide and is expressing the endogenous immune cell gene at normal levels is greater by at least 5%, or at least 10%, or at least 15%, or at least 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or at least 100% relative to the doubling time of immune cells whose genome comprises an inhibitory gene transfer polynucleotide targeting an endogenous immune cell gene. Preferably the proliferation rate of immune cells whose genome comprises an inhibitory gene transfer polynucleotide targeting an endogenous immune cell gene is increased by at least 5%, or at least 10%, or at least 15%, or at least 20%, or at least 25%, or at least 30%, or at least 35%, or at least 40%, or at least 45%, or at least 50%, or at least 55%, or at least 60%, or at least 65%, or at least 70%, or at least 75%, or at least 80%, or at least 85%, or at least 90%, or at least 95%, or at least 100% relative to the proliferation rate of immune cells whose genome does not comprise an inhibitory gene transfer polynucleotide and is expressing the endogenous immune cell gene at normal levels.

The proliferation rate of immune cells whose genomes comprise an inhibitory gene transfer polynucleotide may be increased under certain environmental conditions, for example in a tumor micro-environment. The half-life of immune cells whose genomes comprise an inhibitory gene transfer polynucleotide may be increased under certain environmental conditions, for example in a tumor micro-environment. The life span of immune cells whose genomes comprise an inhibitory gene transfer polynucleotide may be increased under certain environmental conditions, for example in a tumor micro-environment. The doubling time of immune cells whose genomes comprise an inhibitory gene transfer polynucleotide may be reduced under certain environmental conditions, for example in a tumor micro-environment.

Cell survival can be measured as the length of time that it takes for only half of the cells in a population to remain alive (the half-life), or the time it takes all the cells in a population to die (the maximum life span). Immune cells expressing an inhibitory gene transfer polynucleotide targeting an immune cell inhibitory gene will remain alive for longer than immune cells that are not expressing an inhibitory gene transfer polynucleotide. One way of measuring this effect is to integrate an inhibitory gene transfer polynucleotide into the genome of the immune cell, wherein said polynucleotide comprises a multi-hairpin amiRNA targeting an endogenous immune cell inhibitory gene, operably linked to regulatory sequences that cause the multi-hairpin amiRNA to be expressed within the immune cell. Cells whose genomes comprise the inhibitory gene transfer polynucleotide express the amiRNAs, whose guide strand RNAs are loaded into the RISC complex and inhibit expression of the target mRNA. Enhancement of survival can be measured as an increase in the half-life of immune cells expressing the multihairpin amiRNA relative to immune cells that are not expressing the amiRNA, either in vitro or in vivo.

Cell proliferation can be measured as the length of time that it takes the number of cells in a population to double (the doubling time), or as the fraction by which a cell population increases in a unit length of time (the proliferation rate). Immune cells expressing a multi-hairpin amiRNA targeting an endogenous immune cell inhibitory gene may divide for longer, or they may divide more rapidly than immune cells that are not expressing the multi-hairpin amiRNA. Enhancement of proliferation can be measured as a decrease in the doubling time of immune cells expressing the multi-hairpin amiRNA relative to immune cells that are expressing the endogenous immune cell inhibitory gene normally. The proliferation rate or the doubling time may be measured at various times after the immune cell has begun expressing the multi-hairpin amiRNA. The proliferation rate of immune cells expressing a multi-hairpin amiRNA may be increased relative to the proliferation rate of the same immune cells that are not expressing a multi-hairpin amiRNA 5 days after, or 10 days after, or 15 days after, or 20 days after, or 25 days after, or 30 days after, or 35 days after, or 40 days after, or 45 days after, or 50 days after, or 55 days after, or 60 days after the inhibitory gene transfer polynucleotide is integrated into the genome of the immune cells.

The ability of T-cells to kill a target tumor cell can be measured as the number of T-cells required to kill a fixed number of target cells under certain defined conditions. T-cells with a higher killing efficiency can kill a larger number of tumor cells. The tumor killing may be measured by mixing the T-cells with the target cells in vitro, for example in cell culture. The tumor killing may also be measured in vivo, for example in an animal model where a known number of tumor cells are introduced into the animal, or when a tumor in the animal has grown to a certain size. T-cells expressing an inhibitory gene transfer polynucleotide targeting an immune cell inhibitory gene will remain alive for longer than immune cells that are not expressing an inhibitory gene transfer polynucleotide. They will also retain their ability to kill the tumor cells. Enhancement of tumor killing can be measured as the number of T-cells whose genomes comprise a multi-hairpin amiRNA targeting the immune cell inhibitory gene required to kill a known number of tumor cells, compared with the number of T-cells that are expressing the immune cell inhibitory gene normally. The tumor killing by T-cells whose genomes comprise a multi-hairpin amiRNA targeting an immune cell inhibitory gene may be increased by a factor of 2 (that is, twice as many T cells expressing the immune cell inhibitory gene normally are required to kill the same number of tumor cells), or tumor killing may be increased by a factor of 3, or tumor killing may be increased by a factor of 4, or tumor killing may be increased by a factor of 5, or tumor killing may be increased by a factor of 6, or tumor killing may be increased by a factor of 7, or tumor killing may be increased by a factor of 8, or tumor killing may be increased by a factor of 9, or tumor killing may be increased by a factor of 10 or more.

In some embodiments of the invention, an inhibitory gene transfer polynucleotide comprises two hairpins processable by the RNA processing enzymes Drosha and Dicer such that a first and second guide RNA are loaded into the RISC complex, and the first and second guide RNAs are complementary to and inhibit the expression of the same endogenous immune cell mRNA. The immune cell mRNA may be any natural immune cell gene. The immune cell gene may be selected from one of the following: TOX, TOX2, PD-1, CTLA-4, TIM-3, Nur77, Nuur1, NOR1, NFAT, FAS receptor, caspase 3, caspase 7, caspase 8, caspase 9, caspase 10, death receptor 4, death receptor 5, Apaf1, Blimp1, BTLA, LAG-3, TIGIT, beta-2-microglobulin, a constant region of the T-cell receptor. Preferably the expression of the target gene is reduced to less than 50%, or less than 40% or less than 30% or less than 20% or less than 15% or less than 10% or less than 9% or less than 8% or less than 7% or less than 6% or less than 5% or less than 4% or less than 3% or less than 2% or less than 1% of the normal expression level of the target gene in an immune cell whose genome does not comprise the inhibitory gene transfer polynucleotide.

5.9 Target Combinations

It may be advantageous to inhibit the expression of multiple genes endogenous to a cultured mammalian cell simultaneously. This may be done by combining guide strand sequences targeting different mRNAs with the appropriate loops and passenger strand sequences to form hairpins, preferably stabilized with hairpin-stabilizing sequences to the 5' and 3' of the guide-loop-passenger strand sequence as described in Section 5.2.4. Any number of genes may be targeted by an inhibitory gene transfer polynucleotide, and multiple inhibitory gene transfer polynucleotides may be integrated into the genome of a cultured mammalian cell.

5.10 Kits

The present invention also features kits comprising a transposase as a protein or encoded by a nucleic acid, and/or a transposon; or a gene transfer system as described herein comprising a transposase as a protein or encoded by a nucleic acid as described herein, in combination with a transposon; optionally together with a pharmaceutically acceptable carrier, adjuvant or vehicle, and optionally with instructions for use. Any of the components of the inventive kit may be administered and/or transfected into cells in a subsequent order or in parallel, e.g. a transposase protein or its encoding nucleic acid may be administered and/or transfected into a cell as defined above prior to, simultaneously with or subsequent to administration and/or transfection of a transposon. Alternatively, a transposon may be transfected into a cell as defined above prior to, simultaneously with or subsequent to transfection of a transposase protein or its encoding nucleic acid. If transfected in parallel, preferably both components are provided in a separated formulation and/or mixed with each other directly prior to administration to avoid transposition prior to transfection. Additionally, administration and/or transfection of at least one component of the kit may occur in a time staggered mode, e.g. by administering multiple doses of this component.

6. EXAMPLES

The following examples illustrate the methods, compositions and kits disclosed herein and should not be construed as limiting in any way. Various equivalents will be apparent from the following examples; such equivalents are also contemplated to be part of the invention disclosed herein.

6.1 Reducing Fucosylation of Secreted Proteins

6.1.1 Micro Rna Reduction of Antibody Fucosylation 6.1.1.1 Elimination of Fucosylation of a Stably Expressed Antibody We used multi-hairpin amiRNA genes to suppress fucosylation of an antibody. The antibody had mature light chain sequence given by SEQ ID NO: 870 and mature heavy chain sequence given by SEQ ID NO: 869, the genes encoding the antibody were integrated into the genome of a CHO cell line on a transposon which further comprised a left end comprising a 5'-TTAA-3' target sequence immediately followed by an ITR with SEQ ID NO: 1006 (which is an embodiment of SEQ ID NO: 1004) and additional sequence with SEQ ID NO: 1000 and a right end comprising SEQ ID NO: 1002 immediately followed by an ITR with SEQ ID NO: 1007 (which is an embodiment of SEQ ID NO: 1005) immediately followed by a 5'-TTAA-3' target sequence. The transposon further comprised a gene encoding a glutamine synthetase selectable marker.

Three different multi-hairpin amiRNA genes targeting *Criteculus griseus* alpha-(1,6)-fucosyl transferase (FUT8) mRNA, (which has SEQ ID NO: 1) were constructed. Two multi-hairpin amiRNAs, with sequences given by SEQ ID NO: 725 and 726, each comprised three hairpins; the first hairpin comprised guide strand sequence SEQ ID NO: 75, immediately followed by loop sequence SEQ ID NO:683 and passenger strand sequence SEQ ID NO: 379, the second hairpin comprised guide strand sequence SEQ ID NO: 76, immediately followed by loop sequence SEQ ID NO: 683 and passenger strand sequence SEQ ID NO: 380, the third hairpin comprised guide strand sequence SEQ ID NO: 77, immediately followed by loop sequence SEQ ID NO: 683 and passenger strand sequence SEQ ID NO: 381. Each of these three guide strand sequences was a 22 base sequence that was an exact reverse complement of a different region within the *Criteculus griseus* alpha-(1,6)-fucosyl transferase (FUT8) mRNA. Each passenger strand sequence was complementary to its corresponding guide strand sequence, except that the bases in the passenger strand sequences corresponding to the 5' base of the guide strand and the twelfth base of the guide strand were changed to be non-complementary. The first and twelfth bases of guide strand with SEQ ID NO:75 are G and C respectively, the corresponding bases in the corresponding passenger strand sequence SEQ ID NO: 379 are A and A respectively. The first and twelfth bases of guide strand with SEQ ID NO:76 are T and A respectively, the corresponding bases in the corresponding passenger strand sequence SEQ ID NO: 380 are C and C respectively. The first and twelfth bases of guide strand with SEQ ID NO:77 are T and G respectively, the corresponding bases in the corresponding passenger strand sequence SEQ ID NO: 381 are C and A respectively. Each hairpin in multi-hairpin amiRNA sequences SEQ ID NOs: 725 and 726 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequences SEQ ID NOs: 725 and 726 further comprised an unstructured sequence with SEQ ID NO: 693 to the 5' of the first hairpin, and an unstructured sequence with SEQ ID NO: 695 to the 3' of the third hairpin. Multi-hairpin amiRNA sequences SEQ ID NO: 726 further comprised an unstructured sequence with SEQ ID NO: 716 between the first and second hairpins, and an unstructured sequence with SEQ ID NO: 717 between the second and third hairpins. Each guide strand sequence is different, and each is complementary to the mRNA for Criteculus griseus FUT8 (SEQ ID NO: 1).

The third multi-hairpin amiRNA with sequence given by SEQ ID NO: 727 also comprised three hairpins; the first hairpin comprised guide strand sequence SEQ ID NO: 78, immediately followed by loop sequence SEQ ID NO: 685 and passenger strand sequence SEQ ID NO: 382, the second hairpin comprised guide strand sequence SEQ ID NO: 79, immediately followed by loop sequence SEQ ID NO: 685 and passenger strand sequence SEQ ID NO: 383, the third hairpin comprised guide strand sequence SEQ ID NO: 80, immediately followed by loop sequence SEQ ID NO: 685 and passenger strand sequence SEQ ID NO: 384. Each of these three guide strand sequences was a 21 base sequence that was an exact reverse complement of a different region within the Criteculus griseus alpha-(1,6)-fucosyl transferase (FUT8) mRNA. Each passenger strand sequence was complementary to its corresponding guide strand sequence, except that the bases in the passenger strand sequences corresponding to the twelfth and thirteenth bases of the guide strand were deleted. Each hairpin in multi-hairpin amiRNA sequences SEQ ID NO: 727 further comprised additional stem-stabilizing sequences, with stem sequence SEQ ID NO: 699 immediately preceding the guide strand sequence, and stem sequence SEQ ID NO: 700 immediately following the passenger strand sequence. Multi-hairpin amiRNA sequence SEQ ID NO: 727 further comprised an unstructured sequence with SEQ ID NO: 694 to the 5' of the first hairpin, and an unstructured sequence with SEQ ID NO: 696 to the 3' of the third hairpin. Each guide strand sequence is different, and each is complementary to the mRNA for Criteculus griseus FUT8 (SEQ ID NO: 1).

Each of the three multi-hairpin amiRNA sequences was placed to the 3' of an open reading frame encoding a red fluorescent protein (given by SEQ ID NO: 723) and followed by a rabbit globin polyadenylation sequence. Each multi-hairpin amiRNA sequence was cloned into a transposon vector in which it was operably linked to a Pol II promoter (either the CMV promoter (with SEQ ID NO: 927) or the EF1 promoter (with SEQ ID NO: 898), as shown in Table 1). The transposon comprised a left end comprising a 5'-TTAA-3' target sequence immediately adjacent to ITR with SEQ ID NO: 1010, immediately followed by an additional sequence with SEQ ID NO: 1008 and a right end comprising SEQ ID NO: 1009 immediately followed by an ITR with SEQ ID NO: 1011 immediately followed by a 5'-TTAA-3' target sequence. It further comprised a gene encoding a puromycin selectable marker (with polypeptide sequence SEQ ID NO: 886). The transposons were configured so that the multi-hairpin amiRNA, the fluorescent protein gene, as well as all necessary operably linked control elements were transposable by a corresponding transposase.

Transposons were co-transfected with mRNA encoding transposase SEQ ID NO: 1086 into a clonal CHO cell line expressing an antibody with mature light chain sequence given by SEQ ID NO: 870 and mature heavy chain sequence given by SEQ ID NO: 869. The pool of transfected cells were grown in the presence of 10 μg/ml puromycin until their viability reached 95%. They were then grown in a 14 day fed-batch using Sigma Advanced Fed Batch media. Protein was purified from the culture supernatant using protein A affinity chromatography, reduced with dithiothreitol, and analyzed on an Agilent QTOF mass spectrometer. The mass spectroscopy traces are shown in FIGS. 3A-G. Table 1 shows the varying transposon components used for each trace shown in FIGS. 3A-G.

Figure 3G:
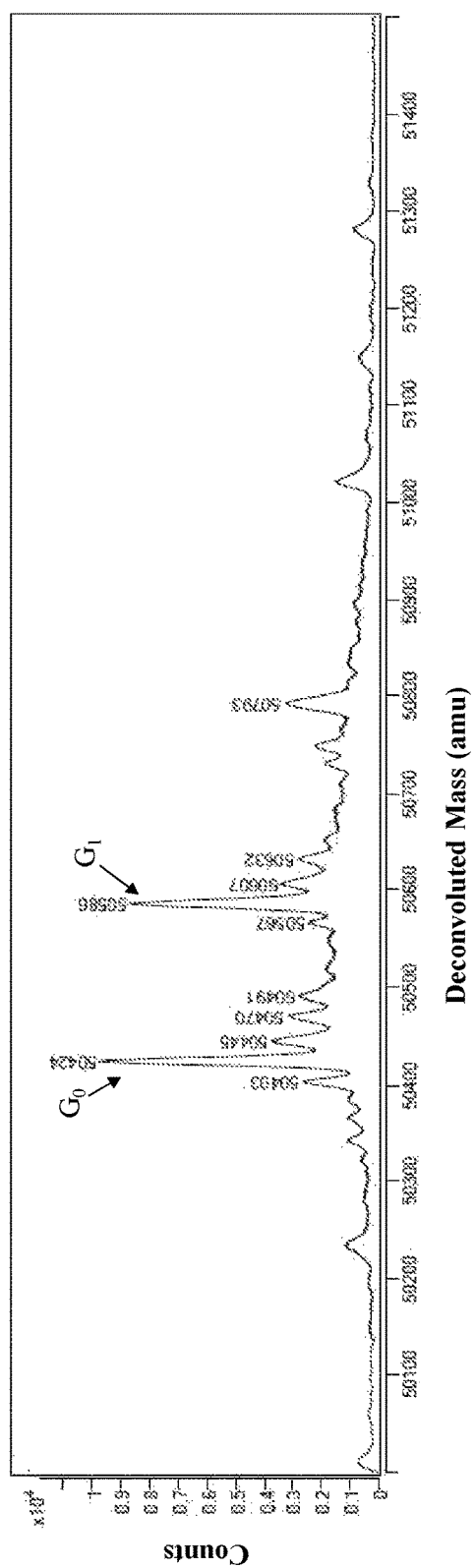

Four mass spectroscopy peaks are identified by arrows in FIGS. 3A-G: (i) at 50,424 Da is the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms; (ii) at 50,571 Da is the heavy chain modified by $G_{0F}$: the conserved heptasccharide core plus a fucose residue; (iii) at 50,586 Da is the heavy chain modified by $G_1$: the conserved heptasccharide core plus a galactose residue and (iv) at 50,733 Da is the heavy chain modified by $G_{1F}$: the conserved heptasccharide core plus a galactose residue and a fucose residue. FIG. 3A shows that in the starting clonal CHO line, there is a small $G_0$ peak at 50,424 Da and a much larger $G_{0F}$ peak at 50,571, showing that the majority of the antibody is fucosylated (approximately 80% using relative peak height or integration under the curves). Similarly, for the starting clonal CHO line there is a significant $G_{1F}$ peak at 50,733. FIGS. 3B-G all show a much larger $G_0$ peak at 50,424 Da, and no detectable $G_{0F}$ peak at 50,571, nor any detectable $G_{1F}$ peak at 50,733. We conclude that all three multi-hairpin amiRNA configurations, with the hairpins operably linked to a PolII promoter active in mammalian cells (either a CMV promoter or an EF1 promoter), inhibited FUT8 expression sufficiently to completely suppress antibody fucosylation.

6.1.1.2 Multi-hairpin amiRNAs Operably Linked to Different Pol II Promoters

We used multi-hairpin amiRNA genes to suppress fucosylation of an antibody with mature light chain sequence given by SEQ ID NO: 870 and mature heavy chain sequence given by SEQ ID NO: 869, where the antibody was stably expressed from the clonal CHO cell line as described in Section 6.1.1.1.

The multi-hairpin amiRNA with sequence given by SEQ ID NO: 726 comprised three hairpins with guides complementary to the mRNA for Criteculus griseus alpha-(1,6)-fucosyl transferase (FUT8), as described in Section 6.1.1.1. The multi-hairpin amiRNA sequence was placed to the 3' of an open reading frame encoding a red fluorescent protein (given by SEQ ID NO: 723) and followed by a rabbit globin polyadenylation sequence. The multi-hairpin amiRNA gene was cloned into three different Bombyx transposon vectors in each of which it was operably linked to a different Pol II promoter that was weaker than the strong EF1 and CMV promoters used in Section 6.1.1.1: a rat EEF2 promoter (with sequence given by SEQ ID NO: 934), a PGK promoter (with sequence given by SEQ ID NO: 969) and a Ubb promoter (with sequence given by SEQ ID NO: 975). The transposon comprised a left end comprising a 5'-TTAA-3' target sequence immediately adjacent to an ITR with SEQ ID NO: 1010 immediately followed by additional sequence with SEQ ID NO: 1008 and a right end comprising SEQ ID NO: 1009 immediately followed by an ITR with SEQ ID NO: 1011 immediately followed by a 5'-TTAA-3' target sequence. It further comprised an open reading frame encoding puromycin selectable marker with polypeptide sequence given by SEQ ID NO: 886. The transposons were configured so that the multi-hairpin amiRNA, the fluorescent protein gene and the selectable marker gene, as well as all necessary operably linked control elements were transposable by a corresponding transposase.

Transposons were co-transfected with mRNA encoding transposase SEQ ID NO: 1086 into a clonal CHO cell line expressing an antibody with mature light chain sequence given by SEQ ID NO: 870 and mature heavy chain sequence given by SEQ ID NO: 869. The pool of transfected cells were grown in the presence of 10 µg/ml puromycin until their viability reached 95%. They were then grown in a 14 day fed-batch using Sigma Advanced Fed Batch media. Protein was purified from the culture supernatant using protein A affinity chromatography, reduced with dithiothreitol, and analyzed on an Agilent QTOF mass spectrometer. The mass spectroscopy traces are shown in FIGS. 4A-D.

Three mass spectroscopy peaks are identified by arrows in FIGS. 4A-D: (i) at 50,424 Da is the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms; (ii) at 50,570 Da is the heavy chain modified by $G_{0F}$: the conserved heptasccharide core plus a fucose residue; (iii) at 23,443 Da is the light chain. FIG. 4A shows that in the starting clonal CHO line, the heavy chain is present primarily as a single $G_{0F}$ peak at 50,570, showing that the majority of the antibody is fucosylated (approximately 85% using relative peak height or integration under the curves). FIG. 4B-D all show a single $G_0$ peak at 50,424 Da, and no detectable $G_{0F}$ peak at 50,570. We conclude that all three of these Pol II promoters, an EEF2 promoter, a PGK promoter or a ubiquitin promoter are capable of driving enough amiRNA expression from a multi-hairpin amiRNA to inhibit FUT8 expression sufficiently to completely suppress antibody fucosylation.

6.1.1.3 Modification of a CHO Cell Line to Act as a Host for Transient Production of Afucosylated Antibodies We used multi-hairpin amiRNA genes to suppress FUT 8 expression in a pool of CHO cells. The cells were subsequently used to express antibodies, which were tested for fucosylation.

The multi-hairpin amiRNA with sequence given by SEQ ID NO: 726 comprised three hairpins with guides complementary to the mRNA for Criteculus griseus alpha-(1,6)-fucosyl transferase (FUT8), as described in Section 6.1.1.1. The multi-hairpin amiRNA sequence was placed to the 3' of an open reading frame encoding a red fluorescent protein (given by SEQ ID NO: 723) and followed by a rabbit globin polyadenylation sequence. The multi-hairpin amiRNA gene was cloned into a Bombyx transposon vector in which it was operably linked to an EF1 promoter (with sequence given by SEQ ID NO: 898). The transposon comprised a left end comprising a 5'-TTAA-3' target sequence immediately adjacent to an ITR with SEQ ID NO: 1010 immediately followed by additional sequence with SEQ ID NO: 1008 and a right end comprising SEQ ID NO: 1009 immediately followed by an ITR with SEQ ID NO: 1011 immediately followed by a 5'-TTAA-3' target sequence. It further comprised an open reading frame encoding puromycin selectable marker with polypeptide sequence given by SEQ ID NO: 886. The transposons were configured so that the multi-hairpin amiRNA, the fluorescent protein gene and the selectable marker gene, as well as all necessary operably linked control elements were transposable by a corresponding transposase.

Transposons were co-transfected with mRNA encoding transposase SEQ ID NO: 1086 into a CHO cell line expressing no heterologous antibody sequences. The pool of transfected cells were grown in the presence of 10 µg/ml puromycin until their viability reached 95%. The pool of cells was then transfected with genes encoding an antibody with mature light chain sequence given by SEQ ID NO: 870 and mature heavy chain sequence given by SEQ ID NO: 871. The parental CHO line containing no amiRNA was also transfected with these antibody-encoding plasmids a control. Transfected cell pools were grown in a 7 day transient culture using ThermoFisher ExpiCHO media. Protein was purified from the culture supernatant using protein A affinity chromatography, reduced with dithiothreitol, and analyzed on an Agilent QTOF mass spectrometer. The mass spectroscopy traces are shown in FIGS. 5A-B.

Three mass spectroscopy peaks are identified by arrows in FIGS. 5A-B: (i) at 50,521 Da is the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms; (ii) at 50,668 Da is the heavy chain modified by $G_{0F}$: the conserved heptasccharide core plus a fucose residue; (iii) at 23,444 Da is the light chain. FIG. 5A shows that in antibodies produced by the parental CHO line, the heavy chain is present primarily as a single $G_{0F}$ peak at 50,668, with no detectable afucosylated heavy chain. FIG. 5B shows when the same antibody is produced from the pool of cells whose genomes comprise the multi-hairpin amiRNA gene, there is a single heavy chain $G_0$ peak at 50,521 Da, and no detectable $G_{0F}$ peak at 50,668. We conclude that stable integration of a multi-hairpin amiRNA gene, comprising SEQ ID NO: 726 operably linked to a PolII promoter, into the CHO genome resulted in a pool of cells in which FUT8 expression was reduced to such a level that they produced only afucosylated antibodies.

6.1.1.4 Elimination of Fucosylation of a Stably Expressed Antibody using a Multi-Hairpin amiRNA Gene Directed Against Multiple Different Genes Fucosylation occurs within the Golgi apparatus. As an alternative to inhibiting fucosyl transferase, fucosylation of secreted antibodies could in principle be prevented by blocking cellular synthesis of fucose. GDP-mannose 4,6-dehydratase (GMD) is a key enzyme in fucose synthesis, and thus a potential target for RNA interference. However there is also a fucose salvage pathway which could circumvent blockade at the GMD step. This can in turn be inhibited by preventing uptake of fucose into the Golgi by inhibiting the GDP-fucose transporter 1 (GFT).

A multi-hairpin amiRNA gene was designed to target both *Criteculus griseus* GDP-Mannose 4,6-dehydratase (GMD), and GDP-fucose transporter 1 (GFT). The multi-hairpin amiRNA, with sequence given by SEQ ID NO: 732, comprised four hairpins; the first hairpin comprised guide strand sequence SEQ ID NO: 87 (complementary to the mRNA for GMD, with sequence SEQ ID NO: 3), immediately followed by loop sequence SEQ ID NO:683 and passenger strand sequence SEQ ID NO: 391; the second hairpin comprised guide strand sequence SEQ ID NO: 93 (complementary to the mRNA for GFT, with sequence given by SEQ ID NO: 5), immediately followed by loop sequence SEQ ID NO:683 and passenger strand sequence SEQ ID NO: 397; the third hairpin comprised guide strand sequence SEQ ID NO:88 (complementary to the mRNA for GMD, with sequence SEQ ID NO: 3), immediately followed by loop sequence SEQ ID NO:683 and passenger strand sequence SEQ ID NO: 392 and the fourth hairpin comprised guide strand sequence SEQ ID NO: 94 (complementary to the mRNA for GFT, with sequence given by SEQ ID NO: 5), immediately followed by loop sequence SEQ ID NO:683 and passenger strand sequence SEQ ID NO: 398. Each passenger strand sequence was complementary to its corresponding guide strand sequence, except that the bases in the passenger strand sequences corresponding to the 5' base of the guide strand and the twelfth base of the guide strand were changed to be non-complementary. The first and twelfth bases of guide strand with SEQ ID NO:87 are T and G respectively, the corresponding bases in the corresponding passenger strand sequence SEQ ID NO: 391 are C and A respectively. The first and twelfth bases of guide strand with SEQ ID NO: 93 are T and C respectively, the corresponding bases in the corresponding passenger strand sequence SEQ ID NO: 397 are C and A respectively. The first and twelfth bases of guide strand with SEQ ID NO: 88 are T and T respectively, the corresponding bases in the corresponding passenger strand sequence SEQ ID NO: 392 are C and C respectively. The first and twelfth bases of guide strand with SEQ ID NO: 94 are T and G respectively, the corresponding bases in the corresponding passenger strand sequence SEQ ID NO: 398 are C and A respectively. Each hairpin in multi-hairpin amiRNA sequence SEQ ID NO: 732 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequences SEQ ID NO: 732 further comprised an unstructured sequence with SEQ ID NO: 693 to the 5' of the first hairpin, and an unstructured sequence with SEQ ID NO: 695 to the 3' of the fourth hairpin. Multi-hairpin amiRNA sequences SEQ ID NO: 732 further comprised an unstructured sequence with SEQ ID NO: 716 between the first and second hairpins, and an unstructured sequence with SEQ ID NO: 717 between the second and third hairpins, and an unstructured sequence with SEQ ID NO: 718 between the third and fourth hairpins. Multi-hairpin amiRNA SEQ ID NO: 732 thus comprises two guide strand sequences complementary to *Criteculus griseus* GMD mRNA, and two guide strand sequences complementary to *Criteculus griseus* GFT mRNA, wherein each guide strand sequence is different.

Multi-hairpin amiRNA sequence with SEQ ID NO: 732 was placed to the 3' of an open reading frame encoding a red fluorescent protein (given by SEQ ID NO: 723) and followed by a rabbit globin polyadenylation sequence. The multi-hairpin amiRNA was then cloned into a transposon vector in which it was operably linked to a Pol II promoter (the human CMV promoter). The transposon comprised a left end comprising a 5'-TTAA-3' target sequence immediately adjacent to ITR with SEQ ID NO: 1010, immediately followed by an additional sequence with SEQ ID NO: 1008 and a right end comprising SEQ ID NO: 1009 immediately followed by an ITR with SEQ ID NO: 1011 immediately followed by a 5'-TTAA-3' target sequence. It further comprised a gene encoding a puromycin selectable marker (with polypeptide sequence SEQ ID NO: 886). The transposons were configured so that the multi-hairpin amiRNA, the fluorescent protein gene, as well as all necessary operably linked control elements were transposable by a corresponding transposase.

Transposons were co-transfected with mRNA encoding transposase SEQ ID NO: 1086 into a clonal CHO cell line expressing an antibody with mature light chain sequence given by SEQ ID NO: 870 and mature heavy chain sequence given by SEQ ID NO: 869. The pool of transfected cells were grown in the presence of 10 μg/ml puromycin until their viability reached 95%. They were then grown in a 14 day fed-batch using Sigma Advanced Fed Batch media. Protein was purified from the culture supernatant using protein A affinity chromatography, reduced with dithiothreitol, and analyzed on an Agilent QTOF mass spectrometer. Table 2 shows the percentage of the antibody heavy chain that was modified by $G_0$ (the conserved heptasccharide core composed of 2 N-acetylglucosamine, 3 mannose and 2 other N-acetylglucosamine residues that are β-1,2 linked to α-6 mannose and α-3 mannose, forming two arms) or Gi (the conserved heptasccharide core plus a galactose residue), compared with the percentage of the antibody heavy chain that was modified by $G_{0F}$ or $G_{1F}$: $G_0$ and $G_1$ with the addition of a fucose residue.

As shown in Table 2, antibody expressed from the control cell line which had not been transfected with a multi-hairpin amiRNA had a fucosylation level of about 75%. In contrast, no fucose was detectable by mass spectroscopy in the pool of cells whose genomes comprised multi-hairpin amiRNA with SEQ ID NO: 732. We conclude that both of these multi-hairpin amiRNAs completely suppressed antibody fucosylation. We conclude that stable integration of a multi-hairpin amiRNA gene, comprising SEQ ID NO: 732 operably linked to a PolII promoter, into the CHO genome resulted in a pool of cells in which GMD and GFT expression were reduced to such a level that they produced only afucosylated antibodies.

6.1.1.5 Modification of a Human Cell Line to Act as a Host for Transient Production of Afucosylated Antibodies Two different multi-hairpin amiRNA sequences were designed to target genes involved in the fucosylation pathway in human cells: alpha-(1,6)-fucosyl transferase (FUT8), GDP-Mannose 4,6-dehydratase (GMD), and GDP-fucose transporter 1 (GFT). One Multi-hairpin amiRNA, with sequence given by SEQ ID NO: 734 comprised three hairpins; the first hairpin comprised guide strand sequence SEQ ID NO: 81, immediately followed by loop sequence SEQ ID NO:683 and passenger strand sequence SEQ ID NO: 385, the second hairpin comprised guide strand sequence SEQ ID NO: 82, immediately followed by loop sequence SEQ ID NO: 683 and passenger strand sequence SEQ ID NO: 386, the third hairpin comprised guide strand sequence SEQ ID NO: 83, immediately followed by loop sequence SEQ ID NO: 683 and passenger strand sequence SEQ ID NO: 387. Each of these three guide strand sequences was a 22 base sequence that was an exact reverse complement of a different region within the Homo sapiens alpha-(1,6)-fucosyl transferase (FUT8) mRNA. Each passenger strand sequence was complementary to its corresponding guide strand sequence, except that the bases in the passenger strand sequences corresponding to the 5' base of the guide strand and the twelfth base of the guide strand were changed to be non-complementary. The first and twelfth bases of guide strand with SEQ ID NO: 81 are T and T respectively, the corresponding bases in the corresponding passenger strand sequence SEQ ID NO: 385 are C and C respectively. The first and twelfth bases of guide strand with SEQ ID NO: 82 are T and T respectively, the corresponding bases in the corresponding passenger strand sequence SEQ ID NO: 386 are C and C respectively. The first and twelfth bases of guide strand with SEQ ID NO: 83 are T and A respectively, the corresponding bases in the corresponding passenger strand sequence SEQ ID NO: 387 are C and C respectively. Each hairpin in multi-hairpin amiRNA sequences SEQ ID NO: 734 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequences SEQ ID NO: 734 further comprised an unstructured sequence with SEQ ID NO: 693 to the 5' of the first hairpin, and an unstructured sequence with SEQ ID NO: 695 to the 3' of the third hairpin. Multi-hairpin amiRNA sequence SEQ ID NO: 734 further comprised an unstructured sequence with SEQ ID NO: 716 between the first and second hairpins, and an unstructured sequence with SEQ ID NO: 717 between the second and third hairpins. Each guide strand sequence is different, and each is complementary to the mRNA for Homo sapiens FUT8 (SEQ ID NO: 7).

A second multi-hairpin amiRNA gene was designed to target both Homo sapiens GDP-Mannose 4,6-dehydratase (GMD) with mRNA sequence given by SEQ ID NO: 8, and GDP-fucose transporter 1 (GFT) with mRNA sequence given by SEQ ID NO: 9. The multi-hairpin amiRNA, with sequence given by SEQ ID NO: 736, comprised four hairpins; the first hairpin comprised guide strand sequence SEQ ID NO: 99 (complementary to the mRNA for human GMD, with sequence SEQ ID NO: 8), immediately followed by loop sequence SEQ ID NO:683 and passenger strand sequence SEQ ID NO: 403; the second hairpin comprised guide strand sequence SEQ ID NO: 104 (complementary to the mRNA for human GFT, with sequence given by SEQ ID NO: 9), immediately followed by loop sequence SEQ ID NO:683 and passenger strand sequence SEQ ID NO: 408; the third hairpin comprised guide strand sequence SEQ ID NO: 102 (complementary to the mRNA for human GFT, with sequence SEQ ID NO: 9), immediately followed by loop sequence SEQ ID NO:683 and passenger strand sequence SEQ ID NO: 406 and the fourth hairpin comprised guide strand sequence SEQ ID NO: 101 (complementary to the mRNA for human GMD, with sequence given by SEQ ID NO: 8), immediately followed by loop sequence SEQ ID NO: 683 and passenger strand sequence SEQ ID NO: 405. Each passenger strand sequence was complementary to its corresponding guide strand sequence, except that the bases in the passenger strand sequences corresponding to the 5' base of the guide strand and the twelfth base of the guide strand were changed to be non-complementary. The first and twelfth bases of guide strand with SEQ ID NO: 99 are T and G respectively, the corresponding bases in the corresponding passenger strand sequence SEQ ID NO: 403 are C and A respectively. The first and twelfth bases of guide strand with SEQ ID NO: 104 are T and A respectively, the corresponding bases in the corresponding passenger strand sequence SEQ ID NO: 408 are C and C respectively. The first and twelfth bases of guide strand with SEQ ID NO: 102 are T and G respectively, the corresponding bases in the corresponding passenger strand sequence SEQ ID NO: 406 are C and A respectively. The first and twelfth bases of guide strand with SEQ ID NO: 101 are T and C respectively, the corresponding bases in the corresponding passenger strand sequence SEQ ID NO: 405 are C and A respectively. Each hairpin in multi-hairpin amiRNA sequence SEQ ID NO: 736 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequence SEQ ID NO: 736 further comprised an unstructured sequence with SEQ ID NO: 693 to the 5' of the first hairpin, and an unstructured sequence with SEQ ID NO: 695 to the 3' of the fourth hairpin. Multi-hairpin amiRNA sequences SEQ ID NO: 732 further comprised an unstructured sequence with SEQ ID NO: 716 between the first and second hairpins, and an unstructured sequence with SEQ ID NO: 717 between the second and third hairpins, and an unstructured sequence with SEQ ID NO: 718 between the third and fourth hairpins. Multi-hairpin amiRNA SEQ ID NO: 736 thus comprises two guide strand sequences complementary to Homo sapiens GMD mRNA, and two guide strand sequences complementary to Homo sapiens GFT mRNA, wherein each guide strand sequence is different.

The multi-hairpin amiRNA sequences were placed to the 3' of an open reading frame encoding a red fluorescent protein (given by SEQ ID NO: 723) and followed by a rabbit globin polyadenylation sequence. Each multi-hairpin amiRNA sequence was cloned into a transposon vector in which it was operably linked to a Pol II promoter (the CMV promoter with SEQ ID NO: 927). The transposon comprised a left end comprising a 5'-TTAA-3' target sequence immediately adjacent to ITR with SEQ ID NO: 1010, immediately followed by an additional sequence with SEQ ID NO: 1008 and a right end comprising SEQ ID NO: 1009 immediately followed by an ITR with SEQ ID NO: 1011 immediately followed by a 5'-TTAA-3' target sequence. It further comprised a gene encoding a puromycin selectable marker (with polypeptide sequence SEQ ID NO: 886). The transposons were configured so that the multi-hairpin amiRNA, the fluorescent protein gene, as well as all necessary operably linked control elements were transposable by a corresponding transposase.

Transposons were co-transfected with mRNA encoding transposase SEQ ID NO: 1086 into a human embryonic kidney (HEK) cell line expressing no heterologous antibody sequences. The pool of transfected cells were grown in the presence of 10 ug/ml puromycin until their viability reached 95%. Each pool of cells was then transfected in two independent reactions with genes encoding an antibody with mature light chain sequence given by SEQ ID NO: 870 and mature heavy chain sequence given by SEQ ID NO: 871. The antibody genes were operably linked to a human CMV promoter and a rabbit globin polyadenylation signal sequence. Transfected cell pools were grown in a 7 day transient culture using ThermoFisher Expi293 media. Protein was purified from the culture supernatant using protein A affinity chromatography, reduced with dithiothreitol, and analyzed on an Agilent QTOF mass spectrometer. Peaks were identified and quantified corresponding to (i) the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms, (ii) the heavy chain modified by $G_0$ plus fucose ($G_{0F}$), (iii) the heavy chain modified by $G_0$ plus an additional galactose residue (Gi), and (iv) the heavy chain modified by $G_0$ plus an additional galactose residue plus fucose ($G1_F$). Table 3 shows the titer of antibody produced by the transfected HEK cell pools, and the fucosylation observed in each case.

In the absence of multi-hairpin amiRNAs, the antibody produced by HEK cells was between 93 and 100% fucosylated (Table 3 rows 1 and 2). Both replicates of cell pools whose genomes comprised the anti-GMD/GFT multi-hairpin amiRNA genes with SEQ ID NO: 736 (Table 3 rows 5 and 6) showed complete abolition of antibody fucosylation. Both replicates of cell pools whose genomes comprised the anti-FUT8 multi-hairpin amiRNA with SEQ ID NO: 734 (Table 3 rows 3 and 4) showed approximately 90% reduction of antibody fucosylation. We conclude that stable integration of multi-hairpin amiRNA genes comprising SEQ ID NO: 734 or 736 into the HEK genome inhibit expression of genes in the fucosylation pathway such that the resulting pool of cells produce largely or entirely afucosylated antibodies.

One of the pools of HEK cells whose genomes comprised the anti-FUT8 multi-hairpin amiRNA with SEQ ID NO: 734 was subjected to single cell cloning. Four monoclonal cell lines were produced. Each of these cell lines was transfected in two independent reactions with genes encoding an antibody with mature light chain sequence given by SEQ ID NO: 870 and mature heavy chain sequence given by SEQ ID NO: 871. The antibody genes were operably linked to a human CMV promoter and a rabbit globin polyadenylation signal sequence. Transfected cells were grown in a 7 day transient culture using ThermoFisher Expi293 media. Protein was purified from the culture supernatant using protein A affinity chromatography, reduced with dithiothreitol, and analyzed on an Agilent QTOF mass spectrometer for the presence of fucosylated antibody, as described above. Table 4 shows the fucosylation level of the antibodies prepared from the clones.

Cells whose genomes did not comprise multi-hairpin amiRNA genes produced antibody that was between 90 and 94% fucosylated (Table 4 rows 1 and 2). The four different clones produced antibodies with significantly different levels of fucosylation, though the level was very similar between replicates made in the same clonal cell line. Clonal cell line 1 produced antibodies that were about 40% fucosylated, antibodies from clonal line 2 were about 20% fucosylated, clonal line 3 produced antibodies about 13% fucosylated, and clonal line 4 produced antibodies with between 6 and 10% fucosylation. Inhibition of fucosylation was stably maintained in at least one of the four clonal lines.

A transposon comprising a multi-hairpin amiRNA gene comprising multiple guide strand sequences, each complementary to a different sequence within the human FUT8 mRNA (with sequence given by SEQ ID NO: 7), can be integrated into the genome of an HEK293 cell to reduce the fucosylation of antibodies produced by the HEK cell. Preferably less than 40% of an antibody produced by the cell line is fucosylated, more preferably less than 20% of an antibody produced by the cell line is fucosylated, more preferably less than 10% of an antibody produced by the cell line is fucosylated.

6.1.2 Dual Functional Micro Rnas: Gene Knockdown and Selectable Marker Attenuation

6.1.2.1 Fucosylation-Targeting microRNAs Incorporated into the 3' UTR of the Selectable Marker Gene As described in Section 5.2.7, it can be advantageous to incorporate multi-hairpin amiRNA sequences into the 3'UTR of a selectable marker gene, particularly when the selectable marker is part of a transposon. After transcription, processing of the amiRNA sequences destabilizes the selectable marker mRNA because it leads to removal of the stabilizing polyA sequences. This means that to supply enough of the selectable marker protein encoded by the selectable marker gene, expression from the transposon will need to be higher than from a transposon without the amiRNA sequences in the selectable marker 3'UTR. Including amiRNA sequences in the 3'UTR of the selectable marker thus either selects for cells whose genomes comprise more copies of the transposon, or for cells in which transposons are integrated in more transcriptionally active regions of the genome. Another advantage is that only a very small addition to transposon size (less than an additional 1,000 bp) can effect a phenotypic change by inhibiting the expression of one or more host genes. For example, this can be done simultaneously with introduction of a gene encoding a protein to be expressed. To demonstrate this, amiRNA sequences were placed into the 3'UTR of a gene for expression of glutamine synthetase in a mammalian cell.

One-two-or three-hairpin amiRNAs were incorporated into the 3' UTR of a glutamine synthetase selectable marker on a transposon. The multi-hairpin amiRNA with sequence given by SEQ ID NO: 726 comprised three hairpins as described in Section 6.1.1.1.

The multi-hairpin amiRNA with sequence given by SEQ ID NO: 728 comprised two hairpins, the first hairpin comprised guide strand sequence SEQ ID NO: 75, immediately followed by loop sequence SEQ ID NO:683 and passenger strand sequence SEQ ID NO: 379, the second hairpin comprised guide strand sequence SEQ ID NO: 76, immediately followed by loop sequence SEQ ID NO: 683 and passenger strand sequence SEQ ID NO: 380. Each of these two guide strand sequences was a 22 base sequence that was an exact reverse complement of a different region within the Criteculus griseus alpha-(1,6)-fucosyl transferase (FUT8) mRNA. Mismatches between guide and passenger strand sequences are as described in Section 6.1.1.1. Each hairpin in multi-hairpin amiRNA sequence SEQ ID NOs: 728 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequence SEQ ID NOs: 728 further comprised an unstructured sequence with SEQ ID NO: 693 to the 5' of the first hairpin, and an unstructured sequence with SEQ ID NO: 695 to the 3' of the third hairpin. Multi-hairpin amiRNA sequence SEQ ID NO: 728 further comprised an unstructured sequence with SEQ ID NO: 716 between the first and second hairpins. Each guide strand sequence is different, and each is complementary to the mRNA for Criteculus griseus FUT8 (SEQ ID NO: 1).

We also designed and synthesized a single hairpin amiRNA with sequence given by SEQ ID NO: 729 comprising one hairpin which comprised guide strand sequence SEQ ID NO: 75, immediately followed by loop sequence SEQ ID NO:683 and passenger strand sequence SEQ ID NO: 379. Mismatches between guide and passenger strand sequences are as described in Section 6.1.1.1. The hairpin in amiRNA sequence SEQ ID NOs: 729 further comprised additional stem-stabilizing sequences, with stem sequence SEQ ID NO: 697 immediately preceding the guide strand sequence, and stem sequence SEQ ID NO: 698 immediately following the passenger strand sequence. The amiRNA sequence SEQ ID NO: 729 further comprised an unstructured sequence with SEQ ID NO: 693 to the 5' of the hairpin, and an unstructured sequence with SEQ ID NO: 695 to the 3' of the hairpin.

These amiRNA sequences were placed to the 3' of an open reading frame encoding a glutamine synthetase protein (with polypeptide sequence given by SEQ ID NO: 891) and followed by a human globin polyadenylation sequence. The amiRNA genes were cloned into a transposon vector in which they were operably linked to a Pol II promoter. The transposon further comprised genes encoding an antibody with mature light chain sequence given by SEQ ID NO: 870 and mature heavy chain sequence given by SEQ ID NO: 872. The transposon further comprised a left end comprising a 5'-TTAA-3' target sequence immediately followed by an ITR with SEQ ID NO: 1006 (which is an embodiment of SEQ ID NO: 1004) and additional sequence with SEQ ID NO: 1000 and a right end comprising SEQ ID NO: 1002 immediately followed by an ITR with SEQ ID NO: 1007 (which is an embodiment of SEQ ID NO: 1005) immediately followed by a 5'-TTAA-3' target sequence. The transposon was configured so that the multi-hairpin amiRNA, the glutamine synthetase gene and the genes for both antibody chains, as well as all necessary operably linked control elements were transposable by a corresponding transposase.

Transposons were co-transfected with mRNA encoding transposase SEQ ID NO: 1056 into a CHO cell line with no functional glutamine synthetase gene. The pool of transfected cells were grown in the absence of glutamine added to the media until their viability reached 95%. They were then grown in a 14 day fed-batch using Sigma Advanced Fed Batch media. Protein was purified from the culture supernatant using protein A affinity chromatography, reduced with dithiothreitol, and analyzed on an Agilent QTOF mass spectrometer. We integrated the area under the peaks at 50,456 Da (corresponding to the heavy chain modified by $G_0$: the conserved heptasccharide core composed of 2 N-acetylglucosamine, 3 mannose and 2 other N-acetylglucosamine residues that are $\beta$-1,2 linked to $\alpha$-6 mannose and $\alpha$-3 mannose, forming two arms) and 50,602 (corresponding to the heavy chain modified by $G_{0F}$: the conserved heptasccharide core plus a fucose residue) to calculate the relative proportion of fucosylated and afucosylated antibody. Results are shown in Table 5.

Table 5 shows that when the strong CMV or EEF2 promoters are operably linked to the glutamine synthetase gene and to the multi-hairpin amiRNAs in its 3' UTR, the antibody is fully afucosylated (Table 5 rows 1 and 2). This is in contrast to the approximately 80-85% fucosylation seen when an equivalent transposon in which there were no amiRNA sequences in the 3'UTR of the glutamine synthetase gene (as described in Sections 6.1.1.1 and 6.1.1.2). Because these promoters are strong, they express high levels of glutamine synthetase, which means that cells do not require many copies of the integrated transposon in order to synthesize enough glutamine to survive. The antibody titer in the culture supernatant is therefore lower: lowest (163 mg/L) in the case of the strongest (CMV) promoter (Table 5 column E), and higher (443 mg/L) with the weaker EEF2 promoter. The CMV and the EEF2 promoter, operably linked to multi-hairpin amiRNA SEQ ID NO: 726 (by incorporating the amiRNA hairpins after the open reading frame encoding the selectable marker, but before the polyA signal sequence) completely eliminated fucosylation of the antibody (Table 5, columns F and G).

When a weaker promoter is operably linked to the glutamine synthetase, and the 3'UTR comprises only a single amiRNA hairpin (amiRNA with SEQ ID NO: 729, Table 5 row 3), the antibody titer is 514 mg/L: about 3-fold higher than when the CMV promoter is used, but the antibody is still about 50% fucosylated, compared with the natural level of around 80-85% as described in Sections 6.1.1.1 and 6.1.1.2. Adding a second amiRNA hairpin to the 3' UTR of the glutamine synthetase (amiRNA SEQ ID NO: 728) has the twin effects of increasing antibody titer (to 770 mg/L) and reducing antibody fucosylation (to 10%), as shown in Table 5 row 4. These effects result from more processing of the selectable marker 3' UTR, which produces more FUT8-targeting RNA in the RISC complex and also increases destabilization of the glutamine synthetase selectable marker mRNA. This trend continues when the PGK promoter is operably linked to a glutamine synthetase gene with a three-hairpin amiRNA in its 3' UTR (SEQ ID NO: 726), as shown in Table 5 row 5. The antibody titer is further increased to 835 mg/L, and fucosylation of the antibody is completely prevented.

This example also demonstrates the benefit of using multi-hairpin amiRNA sequences, wherein two or more different guide strand sequences are complementary to two or more different sequences in the same target mRNA. Use of a single hairpin amiRNA with one guide strand sequence complementary to FUT8 mRNA reduced FUT8 expression which resulted in reduction of antibody fucosylation from approximately 80% to 50%. Use of a multi-hairpin with two different guide strand sequences complementary to different sequences within the FUT8 mRNA reduced FUT8 expression more, and resulted in reduction of antibody fucosylation to 10%. Use of a multi-hairpin with three different guide strand sequences complementary to different sequences within the FUT8 mRNA reduced FUT8 expression even more, and resulted in reduction of antibody fucosylation to below the limit of detection.

6.1.2.2 Fucosylation-Targeting microRNAs Incorporated into the 3' UTR of the Selectable Marker Gene and Driven by Different Promoters As described in Section 6.1.2.1, the multi-hairpin amiRNA with SEQ ID NO: 726 was capable of completely suppressing the fucosylation of the antibody. However we also wished to increase the titer of the antibody. As described in Section 5.2.7, attenuation of expression of the glutamine synthetase selectable marker can improve expression of genes encoded on a transposon. Transcription of the multi-hairpin amiRNA sequences from the PGK promoter as described in Section 6.1.2.1 provided enough guide strand associated with the RISC complex to reduce fucosylation through FUT8 below detectable levels. We therefore wished to attenuate glutamine synthetase expression in a way that would not reduce transcription of the multi-hairpin amiRNA. To do this we tested incorporation of inhibitory 5' UTRs before the glutamine synthetase gene. These should reduce expression of the glutamine synthetase without affecting transcription of the multi-hairpin amiRNA. We also tested expressing glutamine synthetase and multi-hairpin amiRNA with SEQ ID NO: 726 by operably linking it to the weaker HSV-TK promoter in the presence of inhibitory 5' UTRs.

The three-hairpin amiRNA with SEQ ID NO: 726 was incorporated into the 3' UTR of a glutamine synthetase selectable marker on a transposon. The amiRNA sequence was placed to the 3' of an open reading frame encoding a glutamine synthetase protein with polypeptide sequence given by SEQ ID NO: 891 and was followed by a human globin polyadenylation sequence. The amiRNA gene was cloned into different transposon vectors in which it was operably linked to different Pol II promoters. Each transposon further comprised genes encoding an antibody with mature light chain sequence given by SEQ ID NO: 870 and mature heavy chain sequence given by SEQ ID NO: 872. The transposon further comprised a left end comprising a 5'-TTAA-3' target sequence immediately followed by an ITR with SEQ ID NO: 1006 (which is an embodiment of SEQ ID NO: 1004) and additional sequence with SEQ ID NO: 1000 and a right end comprising SEQ ID NO: 1002 immediately followed by an ITR with SEQ ID NO: 1007 (which is an embodiment of SEQ ID NO: 1005) immediately followed by a 5'-TTAA-3' target sequence. The transposon was configured so that the multi-hairpin amiRNA, the glutamine synthetase gene and the genes for both antibody chains, as well as all necessary operably linked control elements were transposable by a corresponding transposase.

Transposons were co-transfected with mRNA encoding transposase SEQ ID NO: 1056 into a CHO cell line with no functional glutamine synthetase gene. The pool of transfected cells were grown in the absence of glutamine added to the media until their viability reached 95%. They were then grown in a 14 day fed-batch using Sigma Advanced Fed Batch media. Protein was purified from the culture supernatant using protein A affinity chromatography, reduced with dithiothreitol, and analyzed on an Agilent QTOF mass spectrometer. We integrated the area under the peaks at 50,456 Da (corresponding to the heavy chain modified by $G_0$: the conserved heptasccharide core composed of 2 N-acetylglucosamine, 3 mannose and 2 other N-acetylglucosamine residues that are β-1,2 linked to α-6 mannose and α-3 mannose, forming two arms) and 50,602 (corresponding to the heavy chain modified by $G_{0F}$: the conserved heptasccharide core plus a fucose residue) to calculate the relative proportion of fucosylated and afucosylated antibody. Results are shown in Table 6.

Table 6 shows that when the inhibitory 5' UTR sequences with SEQ ID NOs 985 or 986 are placed between the PGK promoter and the glutamine synthetase gene, the antibody titer is approximately 2 g/L (Table 6 rows 2 and 3). This is very similar to the titer seen with a more highly attenuated glutamine synthetase but no amiRNA hairpins in the 3' UTR of the gene (Table 6 row 1), and more than twice the titer seen in the absence of this attenuating 5' UTR element in Section 6.1.2.1 and Table 5 row 5. However, in the absence of the amiRNA, 82% of the antibody is fucosylated (Table 6 column G), consistent with the 80-85% fucosylation seen I Sections 6.1.1.1 and 6.1.1.2. When the transposons contained the amiRNA in the 3'UTR of the glutamine synthetase gene, the antibody is fully afucosylated (Table 6 column F). Use of the weaker HSV-TK promoter also resulted in fully afucosylated antibody (Table 6 rows 4 and 5), although the titer was not as high as with the PGK promoter.

The antibody open reading frames in transposons shown in rows 1-5 were operably liked to EF1 promoters. In rows 6-7 the antibody open reading frames were operably linked to CMV promoters. In row 6 the glutamine synthetase gene lacked multi-hairpin amiRNA sequences in the 3' UTR. As with the EF1-driven antibody in row 1, the antibody was approximately 80% fucosylated, with a titer of 4.2 g/L. In row 7 the glutamine synthetase gene comprised multi-hairpin amiRNA sequence with SEQ ID NO: 726 in the 3' UTR. As with the EF1-driven antibody in rows 2-5, antibody fucosylation was completely suppressed, while the titer exceeded 3 g/L.

We conclude that it is possible to incorporate multi-hairpin amiRNAs into the 3' UTR of a selectable marker on a transposon, integrate the transposon into the genome of a cultured mammalian cell and obtain good titers of genes expressed from the transposon while simultaneously completely inhibiting genes endogenous to the cultured mammalian cell. Exemplary sequences of glutamine synthetase genes comprising multi-hairpin amiRNA sequences targeting CHO FUT8 mRNA are given as SEQ ID NOs: 1189-1198.

6.1.3 Engineering of Glutamine Synthetase Knockdown with Micro RNAS 6.1.3.1 Glutamine Synthetase-Targeting microRNAs As described in Section 5.6, multi-hairpin amiRNA with SEQ ID NO 741 comprised 3 guide strand sequences complementary to 3 different sequences in the Chinese hamster glutamine synthetase mRNA. Multi-hairpin amiRNA, with sequence given by SEQ ID NO: 741 comprised three hairpins; the first hairpin comprised guide strand sequence SEQ ID NO: 114, immediately followed by loop sequence SEQ ID NO:683 and passenger strand sequence SEQ ID NO: 418, the second hairpin comprised guide strand sequence SEQ ID NO: 115, immediately followed by loop sequence SEQ ID NO: 683 and passenger strand sequence SEQ ID NO: 419, the third hairpin comprised guide strand sequence SEQ ID NO: 116, immediately followed by loop sequence SEQ ID NO: 683 and passenger strand sequence SEQ ID NO: 420. Each of these three guide strand sequences was a 22 base sequence that was an exact reverse complement of a different region within the Criteculus griseus glutamine synthetase mRNA. Each passenger strand sequence was complementary to its corresponding guide strand sequence, except that the bases in the passenger strand sequences corresponding to the 5' base of the guide strand and the twelfth base of the guide strand were changed to be non-complementary. The first and twelfth bases of guide strand with SEQ ID NO: 114 are T and T respectively, the corresponding bases in the corresponding passenger strand sequence SEQ ID NO: 418 are C and C respectively. The first and twelfth bases of guide strand with SEQ ID NO: 115 are T and A respectively, the corresponding bases in the corresponding passenger strand sequence SEQ ID NO: 419 are C and C respectively. The first and twelfth bases of guide strand with SEQ ID NO: 116 are T and G respectively, the corresponding bases in the corresponding passenger strand sequence SEQ ID NO: 420 are C and A respectively. Each hairpin in multi-hairpin amiRNA sequences SEQ ID NO: 741 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequences SEQ ID NO: 741 further comprised an unstructured sequence with SEQ ID NO: 693 to the 5' of the first hairpin, and an unstructured sequence with SEQ ID NO: 695 to the 3' of the third hairpin. Multi-hairpin amiRNA sequence SEQ ID NO: 741 further comprised an unstructured sequence with SEQ ID NO: 716 between the first and second hairpins, and an unstructured sequence with SEQ ID NO: 717 between the second and third hairpins. Each guide strand sequence is different, and each is complementary to the mRNA for Criteculus griseus glutamine synthetase (SEQ ID NO: 17).

The multi-hairpin amiRNA was cloned into a piggyBac-like transposon to the 3' of a spacer polynucleotide with sequence given by SEQ ID NO: 724, and operably linked to a PGK promoter with sequence given by SEQ ID NO: 969. The sequence of the multi-hairpin amiRNA gene is given as SEQ ID NO: 1180. The piggyBac-like transposon further comprised a selectable marker conferring resistance to G418/neomycin with amino acid sequence given by SEQ ID NO: 880. The piggyBac-like transposon further comprised a target sequence 5'-TTAA-3' immediately followed by an ITR with the sequence of SEQ ID NO: 1032, which is an embodiment of SEQ ID NO: 1030, immediately followed by further transposon end sequences with sequence SEQ ID NO: 1028. The piggyBac-like transposon further comprised a sequence given by SEQ ID NO: 1029, immediately followed by a second ITR with the sequence of SEQ ID NO: 1033 which is an embodiment of SEQ ID NO: 1031, immediately followed by the target sequence 5'-TTAA-3'. The transposon was configured so that the multi-hairpin amiRNA, the spacer polynucleotide and the gene encoding the selectable marker, as well as all necessary operably linked control elements, were transposable by a corresponding transposase. The full sequence of the transposon comprising the multi-hairpin amiRNA gene and selectable marker is given as SEQ ID NO: 1184.

The transposon was co-transfected with mRNA encoding transposase SEQ ID NO: 1107 into a CHO cell line with intact glutamine synthetase genes. The pool of transfected cells were grown in the presence of 600 or 1,000 µg/ml G418 plus 5 mM glutamine until their viability reached 95%.

A control transposon comprised an open reading frame encoding RFP and a selectable marker gene conferring resistance to puromycin, but lacked any multi-hairpin amiRNA sequences. The control transposon was introduced with mRNA encoding its corresponding transposase into the same CHO cell line with an intact glutamine synthetase gene. The pool of transfected cells were grown in the presence of 6 or 8 µg/ml puromycin plus 5 mM glutamine until their viability reached 95%.

After the transfected cell pools had recovered to >95% viability, we tested their ability to grow in the absence of glutamine. Cells were transferred to Sigma Advanced Fed Batch media lacking glutamine to an initial a density of $0.3 \times 10^6$ live cells/ml. The viable cell density was measured at various times after the removal of glutamine. On the fourth day, cells were diluted back to a density of $0.3 \times 10^6$ live cells/ml in media lacking glutamine, to ensure that growing cells had sufficient nutrients. Table 7 shows that the pool of cells transfected with the control transposon lacking a multi-hairpin amiRNA experienced an initial period of slow growth as they adapted to the glutamine-free media, but by day 4 the viable cell density had increased approximately 3-fold (Table 7 columns D and E, compare rows 3 and 5). After this, the viable cell density approximately tripled between dilution on day 4 and day 6 and, doubled again between day 6 and day 8. In contrast, the pool of cells transfected with a transposon comprising the multi-hairpin amiRNA with SEQ ID NO: 741 and selected with 600 µg/ml G418 increased their viable cell density by less than 50% between day 1 and day 4 (Table 7 column C, compare rows 3 and 5), while the pool of cells transfected with a transposon comprising the multi-hairpin amiRNA with SEQ ID NO: 741 and selected with 1,000 µg/ml G418 failed to increase their viable cell density at all (Table 7 column B, compare rows 3 and 5). The viable cell density then began to fall for both pools transfected with a transposon comprising the multi-hairpin amiRNA with SEQ ID NO: 741 at day 6 (Table 7 columns B and C, compare rows 6, 7 and 8). By day 8 the viable cell density had fallen precipitously to less than $0.02 \times 10^6$ live cells/ml. There was no difference between the growth of cells transfected with the control transposon or the transposon comprising the multi-hairpin amiRNA with SEQ ID NO: 741 in the presence of glutamine: all pools grew well. We conclude that a multi-hairpin amiRNA comprising guide strand sequences complementary to three different sequences within the CHO glutamine synthetase mRNA target (SEQ ID NO: 21) can be used to make a CHO cell dependent upon exogenously provided glutamine. The cells in this pool had been selected with neomycin /G418, which allowed growth of cells whose genomes comprised the transposon comprising the multi-hairpin amiRNA. By day 8 the viable cell density had fallen from 300,000 cells /ml to less than 20,000 cells/ml, indicating that less than 7% of the cells were still alive. By using the multi-hairpin amiRNA gene we were able to produce a pool of cells in which expression of the essential metabolic enzyme glutamine synthetase was inhibited to a level that prevents growth of the cell in greater than 93% of the cells in the pool.

The multi-hairpin amiRNA with sequence given as SEQ ID NO: 741 was also cloned into three other piggyBac-like transposons, also to the 3' of a spacer polynucleotide with sequence given by SEQ ID NO: 724. In the first transposon the multi-hairpin amiRNA was operably linked to a PGK promoter with sequence given by SEQ ID NO: 1188. The sequence of this multi-hairpin amiRNA gene is given as Seq ID NO: 1182. In the second transposon the multi-hairpin amiRNA was operably linked to an EF1 promoter with sequence given by SEQ ID NO: 898. The sequence of this multi-hairpin amiRNA gene is given as SEQ ID NO: 1181. In the third transposon the multi-hairpin amiRNA was operably linked to an EEF2 promoter with sequence given by SEQ ID NO: 934. The sequence of this multi-hairpin amiRNA gene is given as SEQ ID NO: 1183. Each of these three piggyBac-like transposons further comprised a selectable marker conferring resistance to puromycin with amino acid sequence given by SEQ ID NO: 886. The piggyBac-like transposon further comprised a target sequence 5'-TTAA-3' immediately followed by an ITR with the sequence of SEQ ID NO: 1010, immediately followed by further transposon end sequences with sequence SEQ ID NO: 1008. The piggyBac-like transposon further comprised a sequence given by SEQ ID NO: 1009, immediately followed by an ITR with the sequence of SEQ ID NO: 1011, immediately followed by the target sequence 5'-TTAA-3'. The transposon was configured so that the multi-hairpin amiRNA, the spacer polynucleotide and the gene encoding the selectable marker, as well as all necessary operably linked control elements, were transposable by a corresponding transposase. The full sequence of the first, second and third transposons comprising the multi-hairpin amiRNA gene and selectable marker are given as SEQ ID NOs: 1186, 1185 and 1187 respectively. Each transposon was separately co-transfected with mRNA encoding transposase SEQ ID NO: 1086 into a CHO cell line with intact glutamine synthetase genes. The pool of transfected cells were grown in the presence of 10 µg/ml puromycin plus 5 mM glutamine until their viability reached 95%. After the cell pools had recovered to >95% viability, we tested their ability to grow in the absence of glutamine. Cells were transferred to Sigma Advanced Fed Batch media lacking glutamine to an initial a density of $0.3 \times 10^6$ live cells/ml. The pool of cells derived from each transposon behaved essentially as shown in Table 7 for the pools selected with 600 or 1,000 ug/ml neomycin. We conclude that multi-hairpin amiRNA sequence with SEQ ID NO: 741 can be operably linked to a variety of different promoters, placed into a variety of different piggyBac-like transposons and integrated into the host genome by the corresponding transposase, in order to inhibit glutamine synthetase expression in CHO cells and make those cells dependent upon exogenously provided glutamine.

6.1.3.2 Clonal Cell Lines Comprising Genomically Integrated Multi-Hairpin amiRNA Directed Toward Glutamine Synthetase Three monoclonal lines (#23, #38 and #129) were derived from the pool transfected with the transposon comprising multi-hairpin amiRNA with SEQ ID NO: 741 and selected with 1,000 μg/ml G418 described in Section 6.1.3.1. Growth of these clonal cell lines in the presence and absence of glutamine was compared with the growth of a cell line in which both genomic copies of the glutamine synthetase gene comprised inactivating mutations.

Cells were transferred to Sigma Advanced Fed Batch media lacking glutamine to an initial a density of $0.3 \times 10^6$ live cells/ml. The viable cell density was measured at various times after the removal of glutamine. Table 8 shows that the clonal cell lines behaved similarly to the cell pool shown in Table 7. All three clonal lines showed a decrease in viable cell density beginning around day 6 (Table 8, columns B, C and D). The cell line in which both genomic copies of the glutamine synthetase gene comprised inactivating mutations showed a somewhat earlier decline in viable cell density, beginning around day 4 (Table 8, column E). In contrast, in the presence of glutamine, the viable cell density in all of the cell lines remained high until between day 7 and day 10. We observed some decrease in viable cell density at day 10. We believe that this is because in this experiment the cells were not diluted into fresh media at day 4. By day 4 in the presence of glutamine all cells had reached their maximum viable cell densities (Table 8 row 5), so by day 10 they were running out of nutrients. We conclude that all three monoclonal cell lines are dependent upon exogenously provided glutamine, and we expect that a glutamine synthetase gene can therefore be used as a selectable marker to select for integration of a second transposon into the genome of the cell.

6.1.3.3 Expression of an Antibody by Using Glutamine Synthetase Selection in a CHO Cell where Glutamine Synthetase has been Knocked Down Using a Multi-Hairpin amiRNA.

Glutamine synthetase selection was used to integrate transposons for antibody expression into the monoclonal lines and the cell line in which both genomic copies of the glutamine synthetase gene comprised inactivating mutations described in Section 6.1.3.2.

One transposon (333286) comprised an open reading frame encoding a polypeptide comprising a mature light chain with sequence given by SEQ ID NO: 870 operably linked to a murine EF1 promoter and a polyadenylation sequence, and an open reading frame encoding a polypeptide comprising a mature heavy chain with sequence given by SEQ ID NO: 872 operably linked to a human EF1 promoter and a polyadenylation sequence. The transposon further comprised an open reading frame with SEQ ID NO: 893 encoding a glutamine synthetase gene with amino acid sequence SEQ ID NO: 892, operably linked to a heterologous promoter and heterologous 3'UTR and polyadenylation signal sequence. A second transposon (346168) comprised an open reading frame encoding a polypeptide comprising a mature light chain with sequence given by SEQ ID NO: 870 operably linked to a human CMV promoter and a polyadenylation sequence, and an open reading frame encoding a polypeptide comprising a mature heavy chain with sequence given by SEQ ID NO: 872 operably linked to a human CMV promoter and a polyadenylation sequence. The transposon further comprised an open reading frame with SEQ ID NO: 893 encoding a glutamine synthetase gene with amino acid sequence SEQ ID NO: 892, operably linked to a heterologous promoter and heterologous 3'UTR and polyadenylation signal sequence. The three guide strand sequences in multi-hairpin amiRNA sequence SEQ ID NO: 741 are all complementary different sequences within the natural 3' UTR of the hamster glutamine synthetase gene. Thus, expression of the glutamine synthetase gene from the transposons comprising the antibody-encoding sequences should not be affected by the anti-glutamine synthetase multi-hairpin amiRNA gene.

Both transposons further comprised a left end comprising a 5'-TTAA-3' target sequence immediately followed by an ITR with SEQ ID NO: 1006 (which is an embodiment of SEQ ID NO: 1004) and additional sequence with SEQ ID NO: 1000 and a right end comprising SEQ ID NO: 1002 immediately followed by an ITR with SEQ ID NO: 1007 (which is an embodiment of SEQ ID NO: 1005) immediately followed by a 5'-TTAA-3' target sequence. The transposons were configured so that the glutamine synthetase gene and the genes for both antibody chains, as well as all necessary operably linked control elements were transposable by a corresponding transposase.

Transposons were co-transfected with mRNA encoding transposase with polypeptide sequence SEQ ID NO: 1056 into four different CHO cell lines: one in which both genomic copies of the gene comprised inactivating deletions, and the other three were clonal cell lines #23, #38 and #129, in which glutamine synthetase was inhibited using a multi-hairpin amiRNA, as described in Sections 6.1.3.1 and 6.1.3.2. The corresponding transposase for these transposons is different than the transposase used to transpose the first transposon, described in Section 6.1.3.1, which comprised the amiRNA gene for inhibiting the natural glutamine synthetase gene in the CHO cell. This ensured that the first transposon was not excised or inactivated by the action of the second transposase. The pools of transfected cells were grown in the absence of glutamine added to the media until their viability reached 95%. They were then grown in a 14 day fed-batch using Sigma Advanced Fed Batch media. Protein concentration in the supernatant was measured using an Octet. Results are shown in Table 9. The amount of antibody produced by cells in which glutamine synthetase expression had initially been inhibited by engineering mutations into the genomic copies of the genes (Table 9 rows 4 and 8) were comparable with the amount of antibody produced by the 3 cell lines in which glutamine synthetase expression was initially inhibited by the amiRNA gene (compare rows 1-3 with row 4, and rows 5-7 with row 8). The attenuated glutamine synthetase gene in the second transposon is thus capable of selecting for the same high level of expression of other genes on the second transposon in cells whose glutamine synthetase expression has been inhibited by interfering RNA as in those whose glutamine synthetase was inhibited by direct genetic mutation of the glutamine synthetase gene.

We conclude that in mammalian cells in which glutamine synthetase expression has been reduced by integrating into the genome a first transposon comprising a multi-hairpin amiRNA gene comprising SEQ ID NO: 741, cells whose genomes comprise a second transposon can be selected by using a gene encoding glutamine synthetase as a selectable marker on the second transposon. The second transposon comprised additional genes expressible in the mammalian cell to produce an antibody. The productivity of this glutamine synthetase knock-down cell line is comparable with the productivity of a cell line in which the glutamine synthetase was inactivated by genomic mutations.

6.1.3.4 Stability of Antibody Expression from a CHO Cell where Glutamine Synthetase has been Knocked Down Using a Multi-Hairpin amiRNA.

The pool of cells obtained by transfecting clone 129 from Section 6.1.3.2 with the antibody-expressing transposon with sequence SEQ ID NO: 874 (as described in Section 6.1.3.3 and shown in Table 9 row 7) was passaged for 30 or 60 population doublings to assess the stability of expression in the presence or absence of G418, the selection initially used to introduce the glutamine-synthetase-inhibiting multi-hairpin amiRNA. A clonal cell line is regarded as "stable" if its productivity after 60 population doublings is still at least 70% of the original productivity. Pools of CHO cells whose genomes include antibody-encoding genes typically show some additional decline in productivity as they are passaged as a result of population dynamics: lower producing cells tend to grow more quickly as they have a lower metabolic burden, and they take over the pool.

After passaging cells were grown in a 14 day fed-batch using Sigma Advanced Fed Batch media. Protein concentration in the supernatant was measured using an Octet. Results are shown in Table 10. Column F shows the antibody titer produced at day 14, column G shows the titer as a percentage of the unpassaged pool (row 1). Table 10 shows that cell pools passaged for 30 or 60 population-doublings in the presence of G418 produced 89% and 85% respectively of the day 14 antibody titer produced by the unpassaged pool. In the absence of G418, stability was even better: even after 60 population-doublings in the absence of G418, the cell pool still produced close to 95% of the day 14 antibody titer produced by the unpassaged pool. All of these titers are substantially above what is generally considered the threshold for "clonal stability".

We conclude that if a gene encoding an essential enzyme is inhibited using genomically-integrated multi-hairpin amiRNA genes, and if the genomic integration of a second polynucleotide comprising a complementing selectable marker provides an alternative way for the cell to perform the inhibited essential function, then the expression of other genes encoded on the second polynucleotide can be stably maintained.

6.1.4 Carboxypeptidase D Knockdown with Micro RNAS

6.1.4.1 Carboxypeptidase D-targeting microRNAs

Carboxypeptidase D is the peptidase that is responsible for removal of the C-terminal lysine from antibody heavy chains produced from CHO cells. We compared the ability of a 3-hairpin amiRNA gene and a 4-hairpin amiRNA gene to reduce expression of carboxypeptidase D and prevent the removal of the C-terminal lysine from an antibody heavy chain.

A 3-hairpin multi-hairpin amiRNA with SEQ ID NO 740 comprised 3 guide strand sequences complementary to 3 different sequences in the Chinese hamster carboxypeptidase mRNA (whose sequence is given by SEQ ID NO: 17). The first hairpin comprised guide strand sequence SEQ ID NO: 111, immediately followed by loop sequence SEQ ID NO:683 and passenger strand sequence SEQ ID NO: 415, the second hairpin comprised guide strand sequence SEQ ID NO: 112, immediately followed by loop sequence SEQ ID NO: 683 and passenger strand sequence SEQ ID NO: 416, the third hairpin comprised guide strand sequence SEQ ID NO: 113, immediately followed by loop sequence SEQ ID NO: 683 and passenger strand sequence SEQ ID NO: 417. Each of these three guide strand sequences was a 22 base sequence that was an exact reverse complement of a different region within the *Criteculus griseus* carboxypeptidase D mRNA. Each passenger strand sequence was complementary to its corresponding guide strand sequence, except that the bases in the passenger strand sequences corresponding to the 5' base of the guide strand and the twelfth base of the guide strand were changed to be non-complementary. The first and twelfth bases of guide strand with SEQ ID NO: 111 are T and G respectively, the corresponding bases in the corresponding passenger strand sequence SEQ ID NO: 415 are C and A respectively. The first and twelfth bases of guide strand with SEQ ID NO: 112 are T and C respectively, the corresponding bases in the corresponding passenger strand sequence SEQ ID NO: 416 are C and A respectively. The first and twelfth bases of guide strand with SEQ ID NO: 113 are T and G respectively, the corresponding bases in the corresponding passenger strand sequence SEQ ID NO: 417 are C and A respectively. Each hairpin in multi-hairpin amiRNA sequences SEQ ID NO: 740 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequences SEQ ID NO: 740 further comprised an unstructured sequence with SEQ ID NO: 693 to the 5' of the first hairpin, and an unstructured sequence with SEQ ID NO: 695 to the 3' of the third hairpin. Multi-hairpin amiRNA sequence SEQ ID NO: 740 further comprised an unstructured sequence with SEQ ID NO: 716 between the first and second hairpins, and an unstructured sequence with SEQ ID NO: 717 between the second and third hairpins. Each guide strand sequence is different, and each is complementary to the mRNA for *Criteculus griseus* carboxypeptidase D (SEQ ID NO: 17).

A 4-hairpin multi-hairpin amiRNA with SEQ ID NO: 1179 comprised 4 guide strand sequences complementary to 4 different sequences in the Chinese hamster carboxypeptidase mRNA (whose sequence is given by SEQ ID NO: 17). The first hairpin comprised guide strand sequence SEQ ID NO: 1173, immediately followed by loop sequence SEQ ID NO:683 and passenger strand sequence SEQ ID NO: 1174, the second hairpin comprised guide strand sequence SEQ ID NO: 1175, immediately followed by loop sequence SEQ ID NO: 683 and passenger strand sequence SEQ ID NO: 1176, the third hairpin comprised guide strand sequence SEQ ID NO: 1177, immediately followed by loop sequence SEQ ID NO: 683 and passenger strand sequence SEQ ID NO: 1178; the fourth hairpin comprised guide strand sequence SEQ ID NO: 111, immediately followed by loop sequence SEQ ID NO:683 and passenger strand sequence SEQ ID NO: 415. Each of these three guide strand sequences was a 22 base sequence that was an exact reverse complement of a different region within the *Criteculus griseus* carboxypeptidase D mRNA. Each passenger strand sequence was complementary to its corresponding guide strand sequence, except that the bases in the passenger strand sequences corresponding to the 5' base of the guide strand and the twelfth base of the guide strand were changed to be non-complementary. The first and twelfth bases of guide strand with SEQ ID NO: 1173 are T and A respectively, the corresponding bases in the corresponding passenger strand sequence SEQ ID NO: 1174 are C and C respectively. The first and twelfth bases of guide strand with SEQ ID NO: 1175 are T and G respectively, the corresponding bases in the corresponding passenger strand sequence SEQ ID NO: 1176 are C and A respectively. The first and twelfth bases of guide strand with SEQ ID NO: 1177 are A and T respectively, the corresponding bases in the corresponding passenger strand sequence SEQ ID NO: 1178 are C and C respectively. The first and twelfth bases of guide strand with SEQ ID NO: 111 are T and G respectively, the corresponding bases in the corresponding passenger strand sequence SEQ ID NO: 415 are C and A respectively. Each hairpin in multi-hairpin amiRNA sequences SEQ ID NO: 1179 further comprised additional stem-stabilizing sequences, with stem sequence SEQ ID NO: 697 immediately preceding the guide strand sequence, and stem sequence SEQ ID NO: 698 immediately following the passenger strand sequence. Multi-hairpin amiRNA sequences SEQ ID NO: 1179 further comprised an unstructured sequence with SEQ ID NO: 693 to the 5' of the first hairpin, and an unstructured sequence with SEQ ID NO: 695 to the 3' of the third hairpin. Multi-hairpin amiRNA sequence SEQ ID NO: 740 further comprised an unstructured sequence with SEQ ID NO: 716 between the first and second hairpins, and an unstructured sequence with SEQ ID NO: 717 between the second and third hairpins, and an unstructured sequence with SEQ ID NO: 718 between the third and fourth hairpins. Each guide strand sequence is different, and each is complementary to the mRNA for *Criteculus griseus* carboxypeptidase D (SEQ ID NO: 17).

Each of the three multi-hairpin amiRNA sequences was placed to the 3' of an open reading frame encoding a red fluorescent protein (given by SEQ ID NO: 723) and followed by a rabbit globin polyadenylation sequence. Each multi-hairpin amiRNA sequence was cloned into a transposon vector in which it was operably linked to a Pol II promoter (the CMV promoter with sequence given by SEQ ID NO: 927). The transposon comprised a left end comprising a 5'-TTAA-3' target sequence immediately adjacent to ITR with SEQ ID NO: 1010, immediately followed by an additional sequence with SEQ ID NO: 1008 and a right end comprising SEQ ID NO: 1009 immediately followed by an ITR with SEQ ID NO: 1011 immediately followed by a 5'-TTAA-3' target sequence. It further comprised a gene encoding a puromycin selectable marker (with polypeptide sequence SEQ ID NO: 886). The transposons were configured so that the multi-hairpin amiRNA, the fluorescent protein gene, as well as all necessary operably linked control elements were transposable by a corresponding transposase.

Transposons were co-transfected with mRNA encoding transposase SEQ ID NO: 1086 into a clonal CHO cell line expressing an antibody with mature light chain sequence given by SEQ ID NO: 870 and mature heavy chain sequence given by SEQ ID NO: 869. Transfected pools of cells were grown in the presence of 10 µg/ml puromycin until their viability reached 95%. They were then grown in a 14 day fed-batch using Sigma Advanced Fed Batch media. Protein was purified from the culture supernatant using protein A affinity chromatography, treated with PNGaseF to remove N-linked glycan structures, reduced with dithiothreitol, and analyzed on an Agilent QTOF mass spectrometer. Unmodified heavy chain had mass 49,252 Da. Removal of the C-terminal lysine reduced this to 49,124 Da. The proportions of antibody heavy chain with and without C-terminal lysine were compared for cells whose genomes comprised one of the multi-hairpin amiRNA genes, and for cells with no multi-hairpin amiRNA genes. Results are shown in Table 11.

As shown in Table 11, production of antibody from CHO cells under normal conditions resulted in complete loss of the C-terminal lysine (row 1). Cells whose genomes comprised a transposon comprising the 3-hairpin multi-hairpin amiRNA sequence with SEQ ID NO: 740 produced antibody in which 50% of the heavy chain was full-length and retained the C-terminal lysine. Cells whose genomes comprised a transposon comprising the 4-hairpin multi-hairpin amiRNA sequence with SEQ ID NO: 1179 produced antibody in which over 70% of the heavy chain was full-length and retained the C-terminal lysine. This suggests that inclusion of an additional guide strand sequence complementary to the target mRNA increased the efficiency with which the target mRNA was silenced.

BRIEF DESCRIPTION OF TABLES

Table 1. Constructs used to generate the data shown in FIGS. 3A-G. Transposons were constructed as described in Section 6.1.1.1. The multi-hairpin amiRNA whose SEQ ID NO is shown in column C was operably linked to the Pol II promoter shown in column B. The corresponding mass spectroscopy trace is shown in the panel of FIGS. 3A-G indicated in column D.

Table 2. Inhibition of antibody fucosylation with amiRNAs targeting GMD and GFT. Transposons were constructed as described in Section 6.1.1.4. The amiRNA SEQ ID NO is shown in column A. Following a 14 day fed batch antibody production run, the percentage of antibody that was afucosylated is shown in column B, the percentage that was fucosylated is shown in column C. BDL =below detection limit.

Table 3. Inhibition of antibody fucosylation in HEK cells with multi-hairpin amiRNAs directed toward different target genes. Transposons were constructed, transfected into HEK cells and selected as described in Section 6.1.1.5. Gene transfer polynucleotides comprised amiRNAs directed toward the genes listed in column A. The multi-hairpin amiRNA had the sequence given by the SEQ ID NO shown in column B; the number of hairpins present in the multi-hairpin amiRNA is shown in column C. Recovered pools were transiently transfected with genes encoding an antibody with mature light chain sequence given by SEQ ID NO: 870 and mature heavy chain sequence given by SEQ ID NO: 871. Following a 7 day culture, the culture supernatant contained the concentration of antibody shown in column F. The percentage of antibody that was afucosylated is shown in column D, the percentage that was fucosylated is shown in column E. BDL =below detection limit.

Table 4. Inhibition of antibody fucosylation in clonal HEK cell lines with multi-hairpin amiRNAs directed toward FUT8. Clonal cell lines were generated from the pools shown in Table 3 rows 3 and 4. The name of the cell line is shown in column A. Clonal lines were transiently transfected with genes encoding an antibody with mature light chain sequence given by SEQ ID NO: 870 and mature heavy chain sequence given by SEQ ID NO: 871. Following a 7 day culture, the culture supernatant contained the concentration of antibody shown in column D. The percentage of antibody that was afucosylated is shown in column B, the percentage that was fucosylated is shown in column C.

Table 5. Inhibition of antibody fucosylation with different numbers of amiRNA hairpins. Transposons were constructed as described in Section 6.1.2.1. The SEQ ID NO of the amiRNA gene including the glutamine synthetase ORF and the globin polyA sequence is given in column A. The Pol II promoter shown in column B was operably linked to the amiRNA whose SEQ ID NO is shown in column C. The amiRNA comprised the number of hairpins shown in column D. Following a 14 day fed batch antibody production run, the culture supernatant contained the concentration of antibody shown in column E. The percentage of antibody that was afucosylated is shown in column F, the percentage that was fucosylated is shown in column G. BDL =below detection limit.

Table 6. Inhibition of antibody fucosylation with multi-hairpin amiRNAs driven by different promoters. Transposons were constructed as described in Section 6.1.2.2. The sequence of the selectable marker glutamine synthetase gene, including multi-hairpin amiRNA sequences in the 3' UTR, is shown in column A. The Pol II promoter shown in column B was operably linked to the inhibitory 5' UTR shown in column C which was operably linked to a glutamine synthetase gene. In the 3' UTR of the glutamine synthetase gene was placed the amiRNA whose SEQ ID NO is shown in column D. Following a 14 day fed batch antibody production run, the culture supernatant contained the concentration of antibody shown in column E. The percentage of antibody that was afucosylated is shown in column F, the percentage that was fucosylated is shown in column G. BDL =below detection limit.

Table 7. Growth of cells with amiRNA targeted toward glutamine synthetase in the absence of glutamine. Cells were transfected with transposons comprising the multi-hairpin amiRNA with SEQ ID NO shown in row 1 and selected by addition of G418 or puromycin at the concentration shown in row 2, as described in Section 6.1.3.1. After cells had recovered to >95% viability, cells were transferred into glutamine-free media at 0.3 x $10^6$ viable cells per ml of media. Viable cell densities were measured at various times after the beginning of the experiment: the number of days after initiation of the experiment are shown in column A. At day 4, cells were diluted back to 0.3×$10^6$ live cells/ml (row 5 is before dilution, row 6 is after dilution). Columns B-E show viable cell densities×$10^6$ live cells/ml.

Table 8. Growth of clonal cell lines with amiRNA targeted toward glutamine synthetase in the absence of glutamine. The pool transfected with a transposon comprising multi-hairpin amiRNA with SEQ ID NO: 741 was cloned, and three clonal lines (clone ID shown in row 1) were grown in the presence or absence of glutamine (glutamine concentration is shown in row 2). Growth was compared with the growth of a cell line comprising inactivating mutations in both genomic copies of the glutamine synthetase gene (columns E and I, indicated as GS KO in line 1). Cells were inoculated at 0.3×$10^6$ viable cells per ml of media. Viable cell densities were measured at various times after the beginning of the experiment: the number of days after initiation of the experiment are shown in column A. Columns B-I show viable cell densities x $10^6$ live cells/ml.

Table 9. Expression of an antibody in a glutamine synthetase knockdown cell. The four cell lines described in Section 6.1.3.2 and shown in Table 8 were transfected with two different transposons comprising open reading frames encoding the heavy and light chains of an antibody, as described in Section 6.1.3.3. Clone IDs are indicated in column 1: three clones were derived from a pool of cells with two intact genomic copies of the glutamine synthetase gene that had been transfected with multi-hairpin amiRNA SEQ ID NO: 741, in the fourth line both genomic copies of the glutamine synthetase gene comprised inactivating mutations (indicated as GS KO in column 1). Transposon SEQ ID NOs are indicated in column 2. Cells were selected as described in Section 6.1.3.3. After recovery they were inoculated for a 14 day fed batch, with samples taken after 7, 10, 12 and 14 days for titer measurement by Octet. Antibody titers measured in the culture supernatant are shown in µg/ml in columns C (day 7), D (day 10), E (day 12) and F (day 14).

Table 10. Stability of expression of an antibody from a glutamine synthetase knockdown cell. The cell pool in which clonal cell line #129 was transfected with transposon with sequence given by SEQ ID NO: 874, as described in Section 6.1.3.3 and shown in Table 9 row 7, were tested for stability by passaging the cells for 0, 30 and 60 population doublings, as shown in column B. Cells were passaged in the presence or absence of G418, whose concentration is shown in column A. After passaging they were inoculated for a 14 day fed batch, with samples taken after 7, 10, 12 and 14 days for titer measurement by Octet. Antibody titers measured in the culture supernatant are shown in µg/ml in columns C (day 7), D (day 10), E (day 12) and F (day 14). The productivity at day 14 is expressed as a % of the productivity of the cell pool that had not undergone passaging (row 1).

Table 11. Inhibition of carboxypeptidase D. Two transposons comprised multi-hairpin amiRNA genes as described in Section 6.1.4. SEQ ID NOs of the multi-hairpin amiRNAs are shown in column A, the number of hairpins is shown in column B. Transposons were transfected into a clonal CHO cell line expressing an antibody, selected, and pools of transfected cells grown to produce antibody as described in Section 6.1.4. Antibody was purified, glycans removed and the protein was analyzed by mass spectroscopy to determine the fraction of heavy chain with a C-terminal lysine.

TABLES

TABLE 1

| | A<br>Construct name | B<br>Promoter | C<br>amiRNA<br>SEQ ID NO | D<br>FIG. 1 panel |
|---|---|---|---|---|
| 1 | none | N/A | none | A |
| 2 | 344641 | EF1 | 725 | B |
| 3 | 344646 | EF1 | 726 | C |
| 4 | 344651 | EF1 | 727 | D |
| 5 | 344645 | CMV | 725 | E |
| 6 | 344650 | CMV | 726 | F |
| 7 | 344655 | CMV | 727 | G |

TABLE 2

| | A<br>SEQ ID NO: | B<br>G0 + G1 % (area) | C<br>G0F + G1F (% area) |
|---|---|---|---|
| 1 | none | 25 | 75 |
| 2 | 732 | 100 | BDL |

TABLE 3

| | A Targeted genes | B SEQ ID NO: | C No of hairpins | D G0 + G1 % (area) | E G0F + G1F (% area) | F Titer (mg/L) |
|---|---|---|---|---|---|---|
| 1 | none | N/A | N/A | BDL | 100 | 233 |
| 2 | none | N/A | N/A | 7 | 93 | 237 |
| 3 | FUT8 | 734 | 3 | 90 | 10 | 353 |
| 4 | FUT8 | 734 | 3 | 89 | 11 | 316 |
| 5 | GMD, GFT | 736 | 4 | 100 | BDL | 126 |
| 6 | GMD, GFT | 736 | 4 | 100 | BDL | 120 |

TABLE 4

| | A Sample | B G0 + G1 % (area) | C G0F + G1F (% area) | D Titer (mg/L) |
|---|---|---|---|---|
| 1 | HEK 293 | 6 | 94 | 217 |
| 2 | HEK 293 | 10 | 90 | 224 |
| 3 | clonal line 1 | 56 | 44 | 208 |
| 4 | clonal line 1 | 59 | 41 | 225 |
| 5 | clonal line 2 | 80 | 20 | 371 |
| 6 | clonal line 2 | 81 | 19 | 379 |
| 7 | clonal line 3 | 87 | 13 | 116 |
| 8 | clonal line 3 | 87 | 13 | 134 |
| 9 | clonal line 4 | 94 | 6 | 258 |
| 10 | clonal line 4 | 90 | 10 | 248 |

TABLE 5

| | A GS/amiRNA SEQ ID NO | B Promoter SEQ ID NO | C amiRNA SEQ ID NO | D No of hairpins | E Titer (mg/L) | F G0 % (area) | G G0F (% area) |
|---|---|---|---|---|---|---|---|
| 1 | 1190 | 927 | 726 | 3 | 163 | 100 | BDL |
| 2 | 1191 | 934 | 726 | 3 | 443 | 100 | BDL |
| 3 | 1192 | 967 | 729 | 1 | 514 | 47.3 | 52.7 |
| 4 | 1193 | 967 | 728 | 2 | 770 | 89.9 | 10.1 |
| 5 | 1189 | 967 | 726 | 3 | 835 | 100 | BDL |

TABLE 6

| | A GS/amiRNA gene SEQ ID NO | B Promoter SEQ ID NO | C 5' UTR SEQ ID NO | D amiRNA SEQ ID NO | E Titer (mg/L) | F G0 % (area) | G G0F (% area) |
|---|---|---|---|---|---|---|---|
| 1 | 707 | 976 | none | none | 2,130 | 18 | 82 |
| 2 | 1194 | 967 | 985 | 726 | 1,837 | 100 | BDL |
| 3 | 1195 | 967 | 986 | 726 | 1,933 | 100 | BDL |
| 4 | 1196 | 976 | 985 | 726 | 821 | 100 | BDL |
| 5 | 1197 | 982 | 986 | 726 | 1,178 | 100 | BDL |
| 6 | 708 | 976 | none | none | 4,200 | 19 | 81 |
| 7 | 1198 | 967 | 986 | 726 | 3,100 | 100 | BDL |

TABLE 7

| | A | B | C | D | E |
|---|---|---|---|---|---|
| 1 | SEQ ID NO | 741 | 741 | none | none |
| 2 | Selection | 1000 ug/ml G418 | 600 ug/ml G418 | 8 ug/ml puromycin | 6 ug/ml puromycin |
| | Day | VCD | VCD | VCD | VCD |
| 3 | 0 | 0.30 | 0.30 | 0.30 | 0.30 |
| 4 | 1 | 0.31 | 0.45 | 0.38 | 0.41 |
| 5 | 4 | 0.30 | 0.47 | 0.99 | 0.85 |
| 6 | 4 | 0.30 | 0.30 | 0.30 | 0.30 |

TABLE 7-continued

| | A | B | C | D | E |
|---|---|---|---|---|---|
| 7 | 6 | 0.26 | 0.21 | 1.11 | 1.00 |
| 8 | 8 | 0.02 | 0.01 | 2.00 | 2.54 |

TABLE 8

| | A | B | C | D | E | F | G | H | I |
|---|---|---|---|---|---|---|---|---|---|
| 1 | clone # | 23 | 38 | 129 | n/a | 23 | 38 | 129 | n/a |
| 2 | glutamine (mM) | 0 | 0 | 0 | 0 | 5 | 5 | 5 | 5 |
| 3 | 0 | 0.30 | 0.30 | 0.30 | 0.30 | 0.30 | 0.30 | 0.30 | 0.30 |
| 4 | 4 | 0.40 | 0.37 | 0.32 | 0.22 | 3.76 | 6.63 | 4.34 | 5.96 |
| 5 | 5 | 0.36 | 0.36 | 0.30 | 0.06 | 3.93 | 6.96 | 5.58 | 5.21 |
| 6 | 6 | 0.23 | 0.28 | 0.25 | 0.05 | 4.13 | 6.70 | 5.79 | 5.75 |
| 7 | 7 | 0.16 | 0.21 | 0.19 | not done | 3.61 | 6.14 | 5.79 | 5.17 |
| 8 | 10 | 0.09 | 0.06 | 0.03 | 0.06 | 0.68 | 0.74 | 3.17 | 1.98 |

TABLE 9

| | A Host cells | B SEQ ID NO. | C day 7 | D day 10 | E day 12 | F day 14 |
|---|---|---|---|---|---|---|
| 1 | amiRNA clone#23 | 873 | 1,517 | 2,669 | 2,915 | 3,324 |
| 2 | amiRNA clone#38 | 873 | 1,638 | 3,083 | 3,480 | 4,193 |
| 3 | amiRNA clone#129 | 873 | 1,827 | 3,023 | 3,236 | 3,729 |
| 4 | GS KO | 873 | 715 | 1,586 | 2,174 | 2,637 |
| 5 | amiRNA clone#23 | 874 | 1,482 | 2,084 | 2,133 | 2,244 |
| 6 | amiRNA clone#38 | 874 | 1,363 | 2,146 | 2,151 | 2,273 |
| 7 | amiRNA clone#129 | 874 | 1,328 | 2,286 | 2,575 | 3,044 |
| 8 | GS KO | 874 | 1,059 | 1,618 | 1,802 | 2,019 |

TABLE 10

| | A G418 Concentration | B Population doublings | C Day 7 | D Day 10 | E Day 12 | F Day 14 | G % of control |
|---|---|---|---|---|---|---|---|
| 1 | 400 ug/ml | 0 | 2,031 | 2,425 | 3,286 | 3,355 | 100 |
| 2 | 400 ug/ml | 30 | 1,123 | 1,999 | 2,887 | 2,997 | 89.3 |
| 3 | 400 ug/ml | 60 | 1,132 | 1,909 | 2,743 | 2,869 | 85.5 |
| 4 | 0 | 30 | 1,605 | 2,350 | 3,241 | 3,418 | 101.9 |
| 5 | 0 | 60 | 1,348 | 2,144 | 3,174 | 3,179 | 94.8 |

TABLE 11

| A SEQ ID NO of amiRNA | B number of hairpins | C % w/o lysine | D % with lysine |
|---|---|---|---|
| n/a | none | 100 | 0 |
| 740 | 3 | 49.9 | 50.1 |
| 1179 | 4 | 29.7 | 70.3 |

7. REFERENCES

All references cited herein are incorporated herein by reference in their entirety and for all purposes to the same extent as if each individual publication or patent or patent application was specifically and individually indicated to be incorporated by reference in its entirety for all purposes. If different versions of a sequence are associated with an accession number at different times, the version associated with the accession number at the effective filing date of this application is meant. The effective filing date means the earlier of the actual filing date or filing date of a priority application referring to the accession number if applicable. Likewise if different versions of a publication, website or the like are published at different times, the version most recently published at the effective filing date of the application is meant unless otherwise indicated.

Any feature, step, element, embodiment, or aspect of the invention can be used in combination with any other unless specifically indicated otherwise. Many modifications and variations of this invention can be made without departing from its spirit and scope, as will be apparent to those skilled in the art. The specific embodiments described herein are offered by way of example only, and the invention is to be limited only by the terms of the appended claims, along with the full scope of equivalents to which such claims are entitled.

SEQUENCE LISTING (1198 sequences)

SEQ ID NO: 1 - DNA, 2824 bp, Artificial sequence
  Synthetic
ttcaggttgctgctctggcttaggccatctatgaccctggtggtgttttcattcactataagtccttcccatctttattaactgagcaagttcagctagtaattttagagaccgaggttcaagcaataacacctatctctgcaataccgtgtggctttcttcaatgtcttacatcctaaggaaaggaagcatgtagagcccaggaagcacaggacaagaaagctgcctccttgtatcaccaggaagatctttttgtaagagtcatcacagtataccagagagactaattttgtctgaagcatcatgtgttgaaacaacagaaacttattttcctgtgtggctaactagaaccagagtacaatgtttccaattctttgagctccgagaagacagaagggagttgaaactctgaaaatgcgggcatggactggttcctggcgttggattatgctcattctttttgcctgggggaccttattgttttatataggtggtcatttggttcgagataatgaccaccctgaccattctagcagagaactctccaagattcttgcaaagctggagcgcttaaaacaacaaaatgaagacttgaggagaatggctgagtctctccgaataccagaaggccctattgatcaggggacagctacaggaagagtccgtgttttagaagaacagcttgttaaggccaaagaacagattgaaaattacaagaaacaagctaggaatgatctgggaaaggatcatgaaatcttaaggaggaggattgaaaatggagctaaagagctctggttttttctacaaagtgaattgaagaaattaaagaaattagaaggaaacgaactccaaagacatgcagatgaaattcttttggatttaggacatcatgaaaggtctatcatgacagatctatactacctcagtcaaacagatggagcaggtgagtggcgggaaaaagaagccaaagatctgacagagctggtccagcggagaataacatatctgcagaatcccaaggactgcagcaaagccagaaagctggtatgtaatatcaacaaaggctgtggctatggatgtcaactccatcatgtggtttactgcttcatgattgcttatggcacccagcgaacactcatcttggaatctcagaattggcgctatgctactggaggatgggagactgtgtttagacctgtaagtgagacatgcacagacaggtctggcctctccactggacactggtcaggtgaagtgaaggacaaaaatgttcaagtggtcgagctccccattgtagacagcctccatcctcgtcctccttacttacccttggctgtaccagaagaccttgcagatcgactcctgagagtccatggtgatcctgcagtgtggtgggtatcccagtttgtcaaatacttgatccgtccacaaccttggctggaaagggaaatagaagaaaccaccaagaagcttggcttcaaacatccagttattggagtccatgtcagacgcactgacaaagtgggaacagaagcagccttccatcccattgaggaatacatggtacacgttgaagaacattttcagcttctcgaacgcagaatgaaagtggataaaaaaagagtgtatctggccactgatgacccttctttgttaaaggaggcaaagacaaagtactccaattatgaatttattagtgataactctatttcttggtcagctggactacacaaccgatacacagaaaattcacttcggggcgtgatcctggatatacactttctctcccaggctgacttccttgtgtgtactttttcatcccaggtctgtagggttgcttatgaaatcatgcaaacactgcatcctgatgcctctgcaaacttccattctttagatgacatctactattttggaggccaaaatgcccacaaccagattgcagtttatcctcaccaacctcgaactaaagaggaaatccccatggaacctggagatatcattggtgtggctggaaaccattggaatggttactctaaaggtgtcaacagaaaactaggaaaaacaggcctgtacccttcctacaaagtccgagagaagatagaaacagtcaaataccctacatatcctgaagctgaaaaatagagatggagtgtaagagattaacaacagaatttagttcagaccatctcagccaagcagaagacccagactaacatatggttcattgacagacatgctccgcaccaagagcaagtgggaaccctcagatgctgcactggtggaacgcctctttgtgaagggctgctgtgccctcaagcccatgcacagtaaaataatgtactcacacataacatacaaatggattattttctactttgccctttaaatattctgtccccatgaaacaaacactgccacattatgtaatttaagtgacacagacgttttgtgtgagacttcaaacatggtgcctatatctgagagacctctgtgatttactgagaagatgagaacagctcccttctgtggggaagttggttcttagtcagtggtggactggccactgaattcactgcaatcaacagattcagaatgagaatggatgtttttcctttatatggttgtctggattttttttaaagtaatttcatcagttcagttcatccacctcattaataaatgaaggaatataccaataaaatcaaatgaaatattcactgtccattaggaagttttataaaacaatgccatgaacaaaaaattctttagtactcaatgtttctggacattctctttgataacaaaaataaattttaaaaaggaa

SEQ ID NO: 2 - DNA, 682 bp, Artificial sequence
  Synthetic
agatggagtgtaagagattaacaacagaatttagttcagaccatctcagccaagcagaagacccagactaacatatggttcattgacagacatgctccgcaccaagagcaagtgggaaccctcagatgctgcactggtggaacgcctctttgtgaagggctgctgtgccctcaagcccatgcacagtaaaataatgtactcacacataacatacaaatggattattttctactttgccctttaaatattctgtccccatgaaacaaacactgccacattatgtaatttaagtgacacagacgttttgtgtgagacttcaaacatggtgcctatatctgagagacctctgtgatttactgagaagatgagaacagctcccttctgtggggaagttggttcttagtcagtggtggactggccactgaattcactgcaatcaacagattcagaatgagaatggatgtttttcctttatatggttgtctggattttttttaaagtaatttcatcagttcagttcatccacctcattaataaatgaaggaatataccaataaaatcaaatgaaatattcactgtccattaggaagttttataaaacaatgccatgaacaaaaaattctttagtactcaatgtttctggacattctctttgataacaaaaataaattttaaaaaggaa

SEQ ID NO: 3 - DNA, 1586 bp, Artificial sequence
  Synthetic
agactgtggcggccgctgcagctccgtgaggcgactggcgcgcgcacccacgtctctgtcggcccgctgccggttccacggttccactcctccttccactcggctgcacgctcacccgcccgcggcgacatggctcacgctcccgctagctgcccgagctccaggaactctggggacggcgataagggcaagcccaggaaggtggcgctcatcacgggcatcaccggccaggatggctcatacttggcagaattcctgctggagaaaggatacgaggttcatggaattgtacggcgatccagttcatttaatacaggtcgaattgaacatttatataagaatccacaggctcatattgaaggaaacatgaagttgcactatggtgacctcaccgacagcacctgcctagtaaaaatcatcaatgaagtcaaacctacagagatctacaatcttggtgcccagagccatgtcaagatttcctttgacttagcagagtacactgcagatgttgatggagttggcaccttgcggcttctggatgcaattaagacttgtggccttataaattctgtgaagttctaccaggcctcaactagtgaactgtatggaaaagtgcaagaaataccccagaaagagaccacccctttctatccaaggtcgccctatggagcagccaaactttatgcctattggattgtagtgaactttcgagaggcttataatctctttgcggtgaacggcattctcttcaatcatgagagtcctagaagaggagctaattttgttactcgaaaaattagccggtcagtagctaagatttaccttggacaactggaatgtttcagtttgggaaatctggacgccaaacgagactggggccatgccaaggactatgtcgaggctatgtggctgatgttacaaaatgatgaaccagaggactttgtcatagctactggggaagttcatagtgtccgtgaatttgttgagaaatcattcatgcacattggaaagaccattgtgtgggaaggaaagaatgaaaatgaagtgggcagatgtaaagagaccggcaaaattcatgtgactgtggatctgaaatactaccgaccaactgaagtggacttcctgcagggagactgctccaaggcgcagcagaaactgaactggaagccccgcgttgcctttgacgagctggtgagggagatggtgcaagccgatgtggagctcatgagaaccaaccccaacgcctgagcacctctacaaaaaattcgcgagacatggactatggtgcagagccagccaaccagagtccagccactcctgagaccatcgaccataaaccctcgactgcctgtgtcgtccccacagctaagagctgggccacaggtttgtgggcaccaggacggggacactccagagctaaggccacttcgcttttgtcaaaggctcctctgaatgattttgggaaatcaagaagtttaaaatcacatactcattttacttgaaattatgtcactagacaacttaaatttttgagtcttgagattgtttttctcttttcttattaaatgatctttctatgaaccagc

SEQ ID NO: 4 - DNA, 338 bp, Artificial sequence
  Synthetic
gcacctctacaaaaaattcgcgagacatggactatggtgcagagccagccaaccagagtccagccactcctgagaccatcgaccataaaccctcgactgcctgtgtcgtccccacagctaagagctgggccacaggtttgtgggcaccaggacggggacactccagagctaaggccacttcgcttttgtcaaaggctcctctgaatgattttgggaaatcaagaagtttaaaatcacatactcattttacttgaaattatgtcactagacaacttaaatttttgagtcttgagattgtttttctcttttcttattaaatgatctttctatgaaccagc

SEQ ID NO: 5 - DNA, 2658 bp, Artificial sequence
  Synthetic
ggaagtcgtactggggagggccgcgtagcagatgcagccgagggcggcgctgccaggtacacccgagggcaccgcgggggtgagcgccaggtccctgaaccagccaggcctccagagccgagtccggcggaccgacgggcccctctgaagcggtccaggatcctgcgcatggcgctgactggaggctccactgcctctgaggaggcagatgaagacagcaggaacaagccgtttctgctgcgggcgctgcagatcgcgctggtcgtctctctctactgggtcacctccatctccatggtattcctcaacaagtacctgctggacagcccctccctgcagctggatacccctatcttcgtcactttctaccaatgcctggtgacctctctgctgtgcaagggcctcagcactctggccacctgctgccctggcaccgttgacttccccaccctgaacctggaccttaaggtggcccgcagcgtgctgccactgtcggtagtcttcattggcatgataagtttcaataacctctgcctcaagtacgtaggggtggccttctacaacgtggggcgctcgctcaccaccgtgttcaatgtgcttctgtcctacctgctgctcaaacagaccacttccttctatgccctgctcacatgtggcatcatcattggtggtttctggctgggtatagaccaagagggagctgagggcaccctgtccctcataggcaccatcttcggggtgctggccagcctctgcgtctccctcaatgccatctataccaagaaggtgctcccagcagtggacaacagcatctggcgcctaaccttctataacaatgtcaatgcctgtgtgctcttcttgcccctgatggttctgctgggtgagctccgtgccctccttgactttgctcatctgtacagtgcccacttctggctcatgatgacgctgggtggcctcttcggctttgccattggctatgtgacaggactgcagatcaaattcaccagtcccctgacccacaatgtatcaggcacagccaaggcctgtgcgcagacagtgctggccgtgctctactatgaagagactaagagcttcctgtggtggacaagcaacctgatggtgctgggtggctcctcagcctatacctgggtcaggggctgggagatgcagaagacccaagaggaccccagctccaaagagggtgagaagagtgctattggggtgtgagcttcttcagggacctgggactgaacccaagtggggcctacacagcactgaaggcttcccatggagctagccagtgtggccctgagcaatactgtttacatcctccttggaatatgatctaagaggagccagggtctttcctggtaatgtcagaaagctgccaaatctcctgtctgccccatcttgttttgggaaaaccctaccaggaatggcacccctacctgcctcctcctagagcctgtctacctccatatcatctctggggttgggaccagctgcagccttaaggggctggattgatgaagtgatgtcttctacacaagggagatgggttgtgatcccactaattgaagggatttgggtgaccccacacctctgggatccagggcaggtagagtagtagcttaggtgctattaacatcaggaacacctcagcctgcctttgaagggaagtgggagcttggccaagggaggaaatggccattctgccctcttcagtgtggatgagtatggcagacctgttcatggcagctgcaccctggggtggctgataagaaaacattcacctctgcatttcatatttgcagctctagaacgggggagagccacacatcttttacgggttaagtagggtgatgagctcctccgcagtccctaaccccagctttacctgcctggcttcccttggcccagctacctagctgtactccctttctgtactcttctcttctccgtcatggcctcccccaacacctccatctgcaggcaggaagtggagtccacttgtaacctctgttcccatgacagagccctttgaatacctgaacccctcatgacagtaagagacatttatgttctctggggctggggctgaaggagcccactggttctcacttagcctatctggctcctgtcacaaaaaaaaaaaaagaaaaaaaaaaagcataaaccaagttactaagaacagaagttggtttataacgttctggggcagcaaagcccagatgaagggacccatcgaccctctctgtccatatcctcatgctgcagaagtacaggcaagctcctttaagcctcatataggaacactagcctcactcatgagggttttactccatgacctgtcaacctcaaagccttcaacatgaggactccaacgtaaatttggggacagaagcactcagaccataaccccagcaccacaccctcctaacctcagggtagctgtcattctcctagtctcctctcttgggcctttagaacccccatttccttggggtaatgtctgatgtttttgtccctgtcataaaaagatggagagactgtgtccagcctttgattcctacttcctacaatcccaggttctaatgaagtttgtggggcctgatgccctgagttgtatgtgatttaataataaaaaagcaagataca

SEQ ID NO: 6 - DNA, 1431 bp, Artificial sequence
  Synthetic
gcttcttcagggacctgggactgaacccaagtggggcctacacagcactgaaggcttcccatggagctagccagtgtggccctgagcaatactgtttacatcctccttggaatatgatctaagaggagccagggtctttcctggtaatgtcagaaagctgccaaatctcctgtctgccccatcttgttttgggaaaaccctaccaggaatggcacccctacctgcctcctcctagagcctgtctacctccatatcatctctggggttgggaccagctgcagccttaaggggctggattgatgaagtgatgtcttctacacaagggagatgggttgtgatcccactaattgaagggatttgggtgaccccacacctctgggatccagggcaggtagagtagtagcttaggtgctattaacatcaggaacacctcagcctgcctttgaagggaagtgggagcttggccaagggaggaaatggccattctgccctcttcagtgtggatgagtatggcagacctgttcatggcagctgcaccctggggtggctgataagaaaacattcacctctgcatttcatatttgcagctctagaacgggggagagccacacatcttttacgggttaagtagggtgatgagctcctccgcagtccctaaccccagctttacctgcctggcttcccttggcccagctacctagctgtactccctttctgtactcttctcttctccgtcatggcctcccccaacacctccatctgcaggcaggaagtggagtccacttgtaacctctgttcccatgacagagccctttgaatacctgaacccctcatgacagtaagagacatttatgttctctggggctggggctgaaggagcccactggttctcacttagcctatctggctcctgtcacaaaaaaaaaaaaagaaaaaaaaaaagcataaaccaagttactaagaacagaagttggtttataacgttctggggcagcaaagcccagatgaagggacccatcgaccctctctgtccatatcctcatgctgcagaagtacaggcaagctcctttaagcctcatataggaacactagcctcactcatgagggttttactccatgacctgtcaacctcaaagccttcaacatgaggactccaacgtaaatttggggacagaagcactcagaccataaccccagcaccacaccctcctaacctcagggtagctgtcattctcctagtctcctctcttgggcctttagaacccccatttccttggggtaatgtctgatgtttttgtccctgtcataaaaagatggagagactgtgtccagcctttgattcctacttcctacaatcccaggttctaatgaagtttgtggggcctgatgccctgagttgtatgtgatttaataataaaaaagcaagataca

SEQ ID NO: 7 - DNA, 5164 bp, Artificial sequence
  Synthetic
tttcagttggaaggaggtagggaaaataagtgctttaattcctaggattttggaagtaaaaatggaacaccagacaaaaatggaatttttaggcaaatgtaaagctttgtacttgggtatctcaaagtattatacagtgtaaactatcatgattattaaccaactagaagtagttcttttttttaaattttatttttaattttagacatgagggtcttgctatgttgcccaggctgaagtggctactgacaggcacgatgtggcactgcagcctggaactcttgggcttaagtgatccttcctgcttcttctatcttaaaaaaaaaaagttacgcttgcttgttaaaatatttttaaaatgctgtgtttaaactaagaagtaaatatccaccccacctctgacttctaaaaattatctaaagtatgactggtaagatttttacctttaatcccacataagtctaaaatttgtgttcatttccaacaaccaaagtgtgtcacttttataccagaattttgtcctgcttatacgtttagtacagaaatctcatgggagagagcatccatgcatttacaaattgttattgaattattttattgaatgatgacacccaaactgagctagaacataattctggctctgctagtacatcttctgtgtgatcttggacaagtcactctactttcctttcaattttcttttctcacagggagataatcataaaaacgactgtaaagtacagcacttcatagagtgctttttgtttaaagagctgacaataaatacgagtctcaaggtctaggaaagcctccctcacaacctgagctgcttgaggacaagggattttcttttgaatcagcagtaccttatttgtgtatctgtgatagagttcctggtacataagaaggtctcaataaatatgtgaatttatgaatattaggcagattgcaaccttgacaggccactgcctcttaaatctcctttctgtgatcttttaatatttaacatctaaaaggccgccgctacttgctttgggataagtatccccggtatgtactttaaaatgcccaagcctagagaaatgattcttgtcttaagggcaccatttcgctctcccaccgtaaagcgccccaggcttgggatctgggtcccaaggctacagggaagagtttggaacgggaagctcatcttccggccctctgattggccggctcgcactccactcacgcggcgcgcagctctgattggcctcggcggcacccctcgtcccgcgactactttgtgtgctggggcggcgcgctccggtcctcccgctcagctggcggtctgggctgctctggggcagcccttcggtccactgctctgcatcgcgggcgccgggaattttccgagtccgagcgggttgctgcttttgctcagaggacatccatgaccctaatggtctttttgttcaagataaagtgattttttgcctttgttgattaactggacaaattcagcatgtagagcgcatgaagtacaggacaataaagcttcctacacatatcaccaggaggatctctttgaaagattcactgcaggactaccagagagaataatttgtctgaagcatcatgtgttgaaacaacagaagtctattcacctgtgcactaactagaaacagagttacaatgttttcaattctttgagctccaggactccagggaagtgagttgaaaatctgaaaatgcggccatggactggttcctggcgttggattatgctcattctttttgcctgggggaccttgctgttttatataggtggtcacttggtacgagataatgaccatcctgatcactctagccgagaactgtccaagattctggcaaagcttgaacgcttaaaacaacagaatgaagacttgaggcgaatggccgaatctctccggataccagaaggccctattgatcaggggccagctataggaagagtacgcgttttagaagagcagcttgttaaggccaaagaacagattgaaaattacaagaaacagaccagaaatggtctggggaaggatcatgaaatcctgaggaggaggattgaaaatggagctaaagagctctggtttttcctacagagtgaattgaagaaattaaagaacttagaaggaaatgaactccaaagacatgcagatgaatttcttttggatttaggacatcatgaaaggtctataatgacggatctatactacctcagtcagacagatggagcaggtgattggcgggaaaaagaggccaaagatctgacagaactggttcagcggagaataacatatcttcagaatcccaaggactgcagcaaagccaaaaagctggtgtgtaatatcaacaaaggctgtggctatggctgtcagctccatcatgtggtctactgcttcatgattgcatatggcacccagcgaacactcatcttggaatctcagaattggcgctatgctactggtggatgggagactgtatttaggcctgtaagtgagacatgcacagacagatctggcatctccactggacactggtcaggtgaagtgaaggacaaaaatgttcaagtggtcgagcttcccattgtagacagtcttcatccccgtcctccatatttacccttggctgtaccagaagacctcgcagatcgacttgtacgagtgcatggtgaccctgcagtgtggtgggtgtctcagtttgtcaaatacttgatccgcccacagccttggctagaaaaagaaatagaagaagccaccaagaagcttggcttcaaacatccagttattggagtccatgtcagacgcacagacaaagtgggaacagaagctgccttccatcccattgaagagtacatggtgcatgttgaagaacattttcagcttcttgcacgcagaatgcaagtggacaaaaaaagagtgtatttggccacagatgacccttctttattaaaggaggcaaaaacaaagtaccccaattatgaatttattagtgataactctatttcctggtcagctggactgcacaatcgatacacagaaaattcacttcgtggagtgatcctggatatacattttctctctcaggcagacttcctagtgtgtactttttcatcccaggtctgtcgagttgcttatgaaattatgcaaacactacatcctgatgcctctgcaaacttccattctttagatgacatctactattttgggggccagaatgcccacaatcaaattgccatttatgctcaccaaccccgaactgcagatgaaattcccatggaacctggagatatcattggtgtggctggaaatcattgggatggctattctaaaggtgtcaacaggaaattgggaaggacgggcctatatccctcctacaaagttcgagagaagatagaaacggtcaagtaccccacatatcctgaggctgagaaataaagctcagatggaagagataaacgaccaaactcagttcgaccaaactcagttcaaaccatttcagccaaactgtagatgaagagggctctgatctaacaaaataaggttatatgagtagatactctcagcaccaagagcagctgggaactgacataggcttcaattggtggaattcctctttaacaagggctgcaatgccctcatacccatgcacagtacaataatgtactcacatataacatgcaaacaggttgttttctactttgcccctttcagtatgtccccataagacaaacactgccatattgtgtaatttaagtgacacagacattttgtgtgagacttaaaacatggtgcctatatctgagagacctgtgtgaactattgagaagatcggaacagctccttactctgaggaagttgattcttatttgatggtggtattgtgaccactgaattcactccagtcaacagattcagaatgagaatggacgtttggtttttttttgtttttgtttttgttttttcctttataaggttgtctgtttttttttttttaaataattgcatcagttcattgacctcatcattaataagtgaagaatacatcagaaaataaaatattcactctccattagaaaattttgtaaaacaatgccatgaacaaattctttagtactcaatgtttctggacattctctttgataacaaaaaataaattttaaaaaggaattttgtaaagtttctagaattttatatcattggatgatatgttgatcagccttatgtggaagaactgtgataaaaagaggagctttttagtttttcagcttatttactttgttttttttcctgtttctgatatagtaactaattcttaactcagagacattggtccattttaatactgaaaaccaattttcattggtacacattacaaaattgctaagaacactgtttgggagctttcattctcatattttggacattgttttaattgagtgaaataatcataactccttgctcccagagaagctatcacctccatttctaaaaccatttcaggtttgtttggtagtctttcttaatgtatttattatcgctttttgtgagtagggtcctgttttatccaggaaccaatttctgccctagcctatcatgccctgcttttgagagtaccaggtatctttgggattgggaagctggctgtttcagaagtatatgtctcatagtgtgcagaacttggtgaccaagtgagaagcgggaccaatgggagactcacaatggactgagtcttgggattatcttttccaaattcttccatgttagaatcacttcagaaaataagactttgatgctttgtctctgagcatcatttttctcctcataaaaacacttccttattgtatgtagcctgcctcctacagaggcctggtaggtgttactgcattctaaaagaaaaatgtcatctctgtaggagcgactatcaggcctagtgtgaaatattagggatcctaggcagaagagctattagtcctggccttcatatcttcaccaaatgaaaatactgtatataaaatttcaccaccaaacttaactaaattctttttctcaagtcaagcctcccaaagaaaaaagaaattaacttcctacagtgtcagcaagcaattttccatttagttttggtacaaataaaagtcatttgaaac

SEQ ID NO: 8 - DNA, 1665 bp, Artificial sequence
  Synthetic
ctccctgcacggcctcccgtgcgcccctgtcagactgtggcggccggtcgcgcggtgcgctctccctccctgcccgcagcctggagaggcgcttcgtgctgcacacccccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttctcttttcatattaaaaatggtctttctgtgaactagca

SEQ ID NO: 9 - DNA, 3487 bp, Artificial sequence
  Synthetic
aaggccacgtgggggcgtgtcaggaagtgagtccagggcccgcctcccggggagtcggcctcggatgtccggaggctcctgggctgagccggcgacagagcccgggaaggcagcgagacgtgggcgccggcccagccccctcccgcgtccttcagccccaagccccgagcccctctgacccttccgcagccctccctccagccgcgcccggcctccggcagctccctgtacgcctccctccccctgcccgcccctccctcccacagccgcccatgacgccctctcggcacctcttcccactctgccacgcgtccttttcctgcaccttcgccccgcgtacctactcctgccccgccctgccattcctctcccctcccttctctctgcgacccctccctgttaggccccagcctcttctcccctcacaggtcttctctgtcctggcctcaccgccttatcctattcctctcccttgccctgtgtcttgtctcagagccccctcggggtgggagtaggttgtggagcagcacaactgggctcaccccaaagcagaacttctcaatccatgaggacaatggggaggcctttaggccagcccacatgtgacaatggagggctgcggcttccttgcggagagcacaagtgagctcactgccctggactccagggaatcagagttctggccgcggggtgacccagctcctctgctaccatgaatagggcccctctgaagcggtccaggatcctgcacatggcgctgaccggggcctcagacccctctgcagaggcagaggccaacggggagaagccctttctgctgcgggcattgcagatcgcgctggtggtctccctctactgggtcacctccatctccatggtgttccttaataagtacctgctggacagcccctccctgcggctggacacccccatcttcgtcaccttctaccagtgcctggtgaccacgctgctgtgcaaaggcctcagcgctctggccgcctgctgccctggtgccgtggacttccccagcttgcgcctggacctcagggtggcccgcagcgtcctgcccctgtcggtggtcttcatcggcatgatcaccttcaataacctctgcctcaagtacgtcggtgtggccttctacaatgtgggccgctcactcaccaccgtcttcaacgtgctgctctcctacctgctgctcaagcagaccacctccttctatgccctgctcacctgcggtatcatcatcgggggcttctggcttggtgtggaccaggagggggcagaaggcaccctgtcgtggctgggcaccgtcttcggcgtgctggctagcctctgtgtctcgctcaacgccatctacaccacgaaggtgctcccggcggtggacggcagcatctggcgcctgactttctacaacaacgtcaacgcctgcatcctcttcctgcccctgctcctgctgctcggggagcttcaggccctgcgtgactttgcccagctgggcagtgcccacttctgggggatgatgacgctgggcggcctgtttggctttgccatcggctacgtgacaggactgcagatcaagttcaccagtccgctgacccacaatgtgtcgggcacggccaaggcctgtgcccagacagtgctggccgtgctctactacgaggagaccaagagcttcctctggtggacgagcaacatgatggtgctgggcggctcctccgcctacacctgggtcaggggctgggagatgaagaagactccggaggagcccagccccaaagacagcgagaagagcgccatgggggtgtgagcaccacaggcaccctggatggcccggccccggggcccgtacacaggcggggccagcacagtagtgaaggcggtctcctggaccccagaagcgtgctgtggtgtggactgggtgctacttatagacccaatcagaatacggtggttgagaaggaaccagtgtttacaagtaatatcagaaagttgaaggaaccagtgtttacaagtaataccagaaagttgccaaacccttctctatcctctcgtatttctgagtttttgtccttcccgagggagcaccctagtgagagttgaaccccttccttctgcctccagggcctgtctgcctccacatcactctgaggacagggacaggcaacaaccttgaagggacagcaatggcaaagccacaaaggcttcactgtactcaggggagatggccctaccacagccacctggagagggttgggaagccttccgtctgcggtgggcaggcagcctcaccctgggcccacagaccggccttcctttggaggaaagtgtggcctggactgagggaggaaatgagcgagttccctctgacaccagcagatccccaggggctgctgggcagtggcctgggaatggggtggattgtgagaaagtgctcaccatctatacaccctgtatgtccagcttttgaacacaagggaaccatgcttctcttagaggttaagcagggtcattaacatcctcccccagtccctaacatcacattgtcctgcgtggctcctctggccctgagtggcacctgtccctctggtctcccagcacctggcccaggtaacagccttctgaaagcagagccaaggagctgcttctctcttctcccagttctacctccccagaagccttcctccccaggtggggctgatggagcaagggtccagactaggagccttccaccccagctgtgtctggcgcccctagatctctgcaagggaggtgttacagctggttctgagccgcttgccttgtgatggtaagacaccaacctttacattcttccctgaggttgtggctgacagagcctgcttggccccactgttagtccagcgagctcctatatcaaaatgccgtaggccgggtggcttacaaacaacagaaacgtattgctcacagtcctggggggctgggacgcccaagatcaagaggccagcagattcggactccgctgagggctgtttcccgatccatagatggtgccttctcgctgtatcctcaatggtagaagcacaaacaagcaagctccttcctgcctcttttataaggactccaaccctgttcatgagggttccgcccccatgacccaatcagctccaaaggccccacctcctaatactgtcaccttgggggtgagaattccaatgtgaatttgcagggggagtgggggacacacacaaatttcggggccataccacccttcaccacaccctcctgcgctcagggtggcttgcagtccctggcccttctggtgggcatttggtatgtcctttctcttggggtgatttctgatgtttttactctatatagtgaaaagctagggagagcgggtcttctcccccctccctctccagtcccctcacaatcccagatgggttctaatgcagctgctggggcctgatgccctgagttgtttgtgattcaataaagaatccataag

SEQ ID NO: 10 - DNA, 2365 bp, Artificial sequence
  Synthetic
tttccttttttttttttagctctgaccacccctgtccaagacccgaaggtatgtgctgggggctcagcggtgctgtgcagagacctgaagacagcagtggaatgtggggccttgaaacactgccaacagatggtgtggagcaagcccacagcgaaatcccttccatgtgacatatgcgaaactgttgtcactgaagctgggaacttgctgaaaaataatgccacccaggaagagatccttcgttacctggagaaggcctgtgagtggattcatgactctagcctccagaactcgtgcaaggaggcggttgattcttacctgcctgtcatcctggacatgattaagggggagatgagcaaccctggggaagtgtgctctgcactcaacctgtgccagtctctccagaagtatttggctgagcaaaaccaccagaaacagcttgagtccaacaagatcccggaggtggacatgaccagagtggttgcccccttcatggccaatatccctctcctgatgtaccctcaggatcacccccacagccagttccaatccaagatcaacgatgatgtctgccaggactgtgtgaagatggtgactgacatccagactgctgtgaggaccaatgttacctttgtccagggcttagtggagcatgtcaagcaggagtgtgaccgcctggggccaggcatggctgacatgtgcaagaactacgttgaccagtactctgaagttgccattcagatgatgatgcacatgcaggatcagcaacctaaggaaatctgtgctctggttggcttctgtgatggggtcaagaaagtaccaatgaagactttggtccctgccctggaactgacggactcctatgaggcccccaacattgttttctgcaaggcttgtcagtttgtgatgcagaagttctctgcactaacggctaacaaagacgctgtggatctaatgatgaaatctgtgagcaaagcatgcacactgatccccggtcctgattccaccaagtgcacagaggtgatacaaacgttcggcccctccctgctggacatccttctgcgtgaggtgagcgcagacatgtgtggtgtgatccgcctctgttccggtaaccctgactcagtggagacacttgagcagcccgcagtgcccatcctgtctgcactacccaaacagcctgcattgcgtgccattgtgcctcagaagaagaccggtgggttctgtgaagtgtgcaagaaactggtcagctatttggaacacaacctggagaaaaacagcaccaaggaggagatactggctgcacttgagaagggctgcagctttctgcctgacccctaccagaaggagtgtgatgactttgtgtctgaatatgaacctctgctggtggaaatccttgtgcaagtgatggatccttcctttgtgtgctcgaaaattggggcttgcccttctgcctctaagctgctgctgggaactgagaagtgtgtctggggccctagctactggtgtcagaacatggagactgcagcccggtgcaatgctgtcgaccattgcaaacgccatgtgtggaactaattttccagcttgctgaagttgcagcctatttgtgggtctaggataatgaacacacaagatctatttgacttcattctaagtaggacccctactaccctacccccctttttttgtccttcccccatcttatagcattgctgtcttgtaagaggtgctgatggcccctttcagtgttccccttctgcctgaaggatgaggacattcagggcatcagctctccagctgccctttcacccacctgctggagggggtgctgagccagagagcaggaaggccttctgagccctgacttggtgtacggggtggggcttctgtggccacctcctatcttgaagaggttgctgctcaccttcctgtggtaccgaggagttttctatggatgatttgaagcacagggtaatcaggtctttgggttgatggaattgccatcgtcatagcacagatttcagaagcacctgcaggtggcttgcttgggacactgctttctaggtcagccttcccctctgctttcctgtgttccccctgtctaccttgtttggggttctgtgggctagggtggggaggggaaacttctgaatgtaacttgcccatgccatgtgggcctggccttttgttgtgtgagggtcatgaacagtgttgtcagcttggctgtcagggccctgcacgcccctttcctaccttgtagctcttgttgaattgctctcacctcatcatggatgaagcatctgcctggcagcgggcgatgaactgagaggcctctgtgtagcgtaggtactgttgggaatcttggctg

SEQ ID NO: 11 - DNA, 2615 bp, Artificial sequence
  Synthetic
atgaaaccgcatgtctttgatgacctcagtggctcagtgtccttgtcctgggttggagacagcactggggttattctcgtcctgactactttccaagtgccactggtgattgtgagttttggacagtccaagttatatagaagtgaggattatggaaagaactttaaggatattacaaatctcatcaataacaccttcattcggactgaatttggcatggctattggtcctgagaactccggaaaggtgatattaacagcagaggtatctgggggaagccgaggagggcgagtgttcaggtcatcagactttgccaggaactttgtgcagacagacctgccctttcatcctctgactcagatgctgtacagccctcagaattccgattacctgctagctctcagcaccgagaatggcctgtgggtgtccaagaattttggggaaaaatgggaagaaatccacaaagctgtctgtttggccaaatggggatcagacaacatcatcttctttaccacttatgtgaatggctcctgcaaagctgaccttggtgcactggaattatggagaacatccgacttggggaaaaccttcaaaaccattggtgtgaaaatctactcatttggtcttgggggccgtttcctttttgcctctgtgatggctgataaggatacaacaagaaggatccacgtatcaacagaccaaggggacacatggagcatggcacagcttccttctgtgggacaggagcaattctattctattctggcagccaatgatgacatggtgttcatgcatgtcgatgaacctggagataccggatttggcacaatctttacctctgatgatcgaggcatcgtctactccaagtctctagaccgacatctctacaccaccacaggtggagagaccgactttaccaacgtgacctccctccgtggagtctacataacaagcatgctctcagaagataactctattcagagcatgatcacttttgaccagggaggacggtgggagcacctgcagaagccagagaacagcaagtgtgatgctacggcaaagaacaagaatgagtgcagccttcatattcatgcttcttacagcatctctcagaagctaaatgttccaatggccccactctcagagcccaatgccgtgggcatagtcattgctcatggtagcgtgggagacgccatctcagtgatggtcccagacgtgtacatctcagatgacggtggttactcctgggcaaagatgctagaaggaccccactattataccatcctagattccggaggcattatcgtggccattgagcacagcaaccgtcctatcaatgtgattaagttctccacagatgagggccagtgctggcaaagctatgtgttcacacaggagcccatctacttcactggcctggcttcagagcctggagcccgctctatgaacatcagcatctggggattcaccgagtctttcataacccgccagtgggtctcctacacagtcgatttcaaagatatcctggaacggaactgtgaagaggatgactataccacatggctggcacactccacagaccctggagattacaaagatggctgcattttgggctataaagaacagttcctacggctacgaaagtcatctgtctgtcagaatggtcgagactatgttgcggccaaacagccatccttctgtccctgttccttgaaggacttcctctgtgactttggctacttccgtccagaaaatgcctcggagtgtgtggagcagccggaactgaaggggcatgaattagagttctgtctgtatggcaaggaagagcacttgacgacaaacgggtaccggaaaatcccaggagacagatgccaagggggcatgaatccagctcgagaagtaaaagacttgaaaaagaaatgcacaagcaatttcttgaaccccaagaagcaggactcccgcccacagggacacagcttgtcccagaatccagctccgcctcctcatggatacactgaaaacacacacttcctatctcctacccagaagcagaattccaagtccaattctgttcctattatcctggccatcgtgggattgatgctggtcacagttgtagcaggagtgctcattgtgaagaaatatgtctgtggtggaaggttcctggtccaccgatattctgtgctacagcagcacgcagaggccgatggagtggatgctttggacacagcctcccatgctaaaagcggctatcatgatgattcagatgaggacctcctggaatagctcttcagagaagctggggctgagcgtggatggagccacagtacctcctacactcccagcggctctgacttgggaaaataaatttcccattgcgtcggacccagctctgtttctgctgcttccatccaagcccaaaggacctacactaaagaatgcagggtggggggtggggaaccctaactgatctcacagttgactctgagaagaggggggaaattttaaattcttttaactttttgtttcaagttctgtcttttgtaaacgtgtgggctttaggtttctgttggtttgttaagggaaatgaaatgggattcgaagggattgcttca

SEQ ID NO: 12 - DNA, 1425 bp, Artificial sequence
  Synthetic
atgttgctgctactggctctggtgagtgtggccctggctcatccttttgaggaggactttgatggcaatcgggtgttccgtgtcagtgtacctgatgaagatcacgtcaacttgattcaggagctggccaacaccaagcagattgatttctggaaaccagattctgctgtacaagtgaaacctctcacttcagttgactttcatgttaaagcagaagatgttgccactgtggaggactttctggagaagaatgaatttcattatgaggtattgataagcaacgtgaaaaatcttgtggaagcccagtttgatagccacacccgtgcaactggacacagttacaccaagtataacaactgggaaaagatagaggcttggattcaacaaattgccagcgagaatccacaactcatctctcagagcaccattggaaccacatttgaaggacgtaacatttatctcctcaaggttggcaaagctaaacccaataagcctgccatcttcattgattgtggtttccatgcaagagagtggatttctcctgcattctgtcagtggtttgtaaaaaaggctgtccgaacctatgaacaagagatccacatgaaacagcttcttgatgaattggacttttatgttctgcctgtggtcaacattgatggctatgtctacacctggactaagagccgaatgtggagaaagactcgctctactcgggctggaagtagctgcgtgggtgtagaccctaacagaaattttaatgctggttggtgtgaagtgggagcttctcggagtccctgctctgacacttactgtggaccagctgcagaatctgaaaaggagaccaaggccctcgcagatttcatccgcaagaacctctcctctatcaaggcctatctgactattcactcatactctcagttattgctctacccttactcctatgcaaataagctgcctgcgaactatgaggaattgaatgcgctggtgaaaggtgcggtcaaggaacttgcctctctgcatggcaccaagtacacatatggcccaggagcgtcaaccatctatcttgctgctgggggctctgatgactgggcttatgatcaaggaatcaaatattccttcacttttgaactccgggatacaggcacgtttggctttctccttcctgagtcccagatccgctatacctgtgaggagacaatgcttgcagtcaagtacatagccaattatgtccgagaacatctgtattaatgaagatcacagtgcaccttatttcaaaatgctcactgttcatttctggtctctcttgacttttttgtttgttggaaggctttgaagatcctaatatttcttttaattttctgggtgtactaacctacttggacctctaaaattcatcctaataaaaatcatatcattactagaaaa

SEQ ID NO: 13 - DNA, 1441 bp, Artificial sequence
  Synthetic
ctcccttggggaattttgttgctcagcaagtcactgttgggatgaagctttatggccttggagtcctggtagccatcctcctctgtgagcagtatggcttcgcctttcagagtggccaggttttatctgctcttcccagaacctctaggcaagttcaagttcttcagaatgttactacaacctatgaggtcgttctctggcagccagtgaccgccgaattcatcgaaaagaaaaaagaagtccatttttttgtgaatgcgtctgatgtggacagtgtgaaagcccatttaaacgtgagcagaattccatttagcgtcctgatgaaggatgtggaggacctaattcagcagcagaccgccaatgacaccatcagcccccgagcctcctcatcatactatgagcaatatcactctctaaatgaaatctattcctggatagacgttataaccgaacggtatcctgacatgctccaaaaaatctacattggctcatcatatgagaagtacccactttatgttttaaaggtttcaggagagaaaaaaacaaccaaaaataccatatggatcgactgtggaattcatgccagagagtggatctcacctgctttctgcttgtggttcataggctacgtaacccagttctatgggaaggaaaagatgtataccagtcttctgaggcacgtggatttctacattatgccagtgatgaatgtggatggctacgactacacatggaaaacgaaccgaatgtggagaaagaaccgttctgtctacaagaacaaccgatgtgtgggcacagacctgaacaggaacttcgcttccaaacactggtgtgaggaaggtgcatcgagtttctcctgctctgaaacctactgtggactctatccggagtcagagccggaggtgaaggcagtggccaacttcctgagaagcaatatcaaccacatcaaagcttacatcagcatgcactcatactcccagcaaattctgttcccctattcctataacagaagcaaaagcagggaccatgaggaactgtctctagtggccagtgaagcagctcatgcgattgaaattattaataaaaacagcaggtatacatatggcagtggctcagaaagtttatacctagctcctggaggttccgatgattggatctatgatttgggcatcaaatactcatttacgattgaactgcgagacaaaggcagatacggattcttgctacccgagagatacattaaacctacttgttcagaagctctggctgcagtctccaaaatagtttggcatgtcgtcaggaacgtttaatgcccttgcctctgctcggggtgtttttattttactaatctcagcaacacccaattgtgaactagctttctaagtttaatcagttaccttggttttgtcaaagaataaaatacataacactttgagcttaa

SEQ ID NO: 14 - DNA, 1362 bp, Artificial sequence
  Synthetic
gtttgggcctcagccctaccttcccaacatgcggaggctgctggttctgagtgtgctgctgcaggcagcttttggccatgagaactttgtggggcatcaggttctccgaatttctgcagccgatgaagcccaggtgcagaaagtgaaggagctggaggagctggagcatttgaagctggacttctggcgggaccctgtccggcctggaatccccattgatgtccgagtgcccttctccagcatccaggctgtcaaagtcttcttggaatctgaaggtattagctatgacatcatgattgaagacattcagtccctgttggatgaggaaaagacgcagatgctcgccttccaggccagggccctatccaccaaaaccttcaattatgccacctaccacaccctggaggagatctacgaattcatggacctgctggtggcagagaacccacagcttgtaagcaagatccagattggcaacacttttgaaaatcgccccatttacgtgctgaagttcagcactggagggaccaaccgcccagccatctggattgacactggcatccattcccgagaatgggtcacccaggccagtggggtctggtttgcaaagaagatcactgaagcttacacccaggacccagctttcacggccattcttgacaacatggacatcttcctggagattgtcaccaaccctgatggttttgcctacacccataaaacgaatcgcatgtggcggaagactcgatcacgcacacagggctccctttgcgttggggccgaccccaacaggaactgggatgctggctttgggctggccggagctagtaacaacccctgctcggacacttaccacggcaagtttgccaactctgaagtggaggtcaagtccattgtggactttgtgaagaaacatggaagcatcaaggccttcatctccatccacagctactcccagctccttctctacccctatggctacacatcagaaccagcccctgacaaggaggagctggatcagctcgctaagtctgctgtaacagccttgacatctctgtatgggaccaagtacaagtatggcagtatcattgatacaatctatcaagccagtgggagcactgttgactggacctacagccagggcatcaagtattctttcacttttgaacttcgggacactgggcgcagaggcttcttgctgcctgcctcccagatcatccccacagctgaggagacatggctggcccttctaaccatcatggaccacaccttcaaacacccctactaaagcagccctttagcccctgcctttcccttttccttagccccatctggacaacctaataaagtttgagtgtacaa

SEQ ID NO: 15 - DNA, 1331 bp, Artificial sequence
  Synthetic
tctagactctggggaagctttgagcatgaagttgatcctgttattgggtgccctgtttgggcatgtctactgtcgagaaacatttgtgggagaccaagttcttgagatcatcccaagtaatgaagagcagattaaaactctggtgcaactggaggctgaagagcatcttcagcttgatttttggaaatcacccaccatccccaggcaggcagtccatgtccgagttccttttgtcaacatccaggcggtcaaagttttcctagagtcccaggggattgtttattccatcatgattgaagatgttcaagttctgttggatcaagagcgtgaagaaatgctattcaatcagagaagagagcgcagtggtaacttcaactttggggcctaccatactttggacgagattaaccaagaaatggataacctcgtggccgagcaccctggtctagtgagcaaagtgaatataggttcatcttttgaaaagcggcccatgaatgtgctcaagttcagcaccggaggagacaagccagccatctggctagatgcgggcatccacgctcgagagtgggttacacaagctactgcactgtggacagcaaataagcttgcttctgattatggaactgatccatccatcacttcccttctggaaaccctggatatcttcctgctgcctgtcacaaaccctgatgggtatgtgttctcccacacctctaatcgcatgtggcgaaagacccggtctaaactgtctggaagcatctgtgttggtgtggatcctaatcggaactgggatgcaaatttcggaggacctggagccagtagcagcccttgctctgactcataccatggacccaaggccaactctgaagttgaagtgcaatccatagtgaactttatcaagagtcatgggaaagtcaaagcttttattaccctccacagctactcccagctactcatgttcccctatggctataaatgcaccaagtcagatagctttgatgagctggatgaagtgtcccaaaaggctgcccgatctttgaaaagactacatggtaccagttacaaagtggggccaatctgttccgtcatctaccaagccagtggtggaagcatcgactgggcctatgattttggcatcaaatactcatttgcctttgaactgagagatacaggtgtctatggcttcctcctgccagccaagcagatcttgcccacagcagaagagacctggcttggcctgaagaccatcatggaacatgtacgagatcacccttattagggatctgcagaacagacaaacaccattaaaatctctgtggtgtaaagcaaaa

SEQ ID NO: 16 - DNA, 2216 bp, Artificial sequence
  Synthetic
cccttctccagtgtctggcgaggctggttgtaacccgactccagagcccacggctcctcgcccccccccccagccacccggcccagcagcgccacccgcgcgccccaagtgccacatcactgcacccttcagcgcatctgcgcgcccaccatgcctacaccaccgctgctcttggccgtgctggccacactggccgctgcggctcaccccagctgctctcctggacctgacccctccggtaaatgtcagaggctggcctctacacacagtgacacctgtgtggacctgcatctcaggacctgtgcggatgcagcctacaaccagacatcattccccacacctctagagcaccggtcatgggaggcagtggagtccagccctgagtacattcttctgggtgtgctgcactttctcttagagggccagtgcaaccctgacctgcgactgctggggtgctctgtgctggtcccccgatgtgagggaggtcatacccaaaggccctgccggcatgtctgtgagggtcttcgggaggcctgccagccggcctttgatgccatcgacatggcctggccctacttcctagactgtgccagatacttcacaccagaggaggaaggttgctatgatcctctggaacagcttcggggagatctggatgctgaggaagccctgccttcaggcctgccacctaccttcattcactttgcccaccactcctatgctcagatggccagggtcctgaagaggacagcagctcgctgttcccaggtggccaagacctacagcattgggcgcagctttgaaggcaaggacctgctagtcatcgagtactcaagccgcccaggccagcatgagctgatggagcccgaagtgaagctcattggcaacattcatggcaacgaagtggcaggacgggagatgctcatctacctggcccagtatctgtgctctgagtaccttctgggcaacccccgcatccagcgcctgctcaacaccacccgcatccacctgctgccatccatgaaccccgatggctacgaggtggcagctgcagagggtgctggctacaacggctggatcagcgggaggcagaatgcacagaacctggatctaaaccgcaacttccctgacctgacatcggagtactaccggctggcctccactcgtggtgtgcgaacagaccacatccccatctcacaatactactggtggggtaaggtggcccctgagaccaaggccatcatgaagtggatacagaccattcccttcgtcctctcagccagcctgcatgggggtgacctggtggtgtcctaccccttcgacttttccaagcacccccatgaggaaaagatgttttctcccacacctgatgagaagatgttcaagctgctggcaagagcctatgctgatgtccaccccatgatgatggacaggtcggagaacaggtgtgggggcaacttcttgaagcacgggagcatcatcaacggggcagactggtacagcttcactggagggatgtctgacttcaactacctacacaccaactgctttgagatcacagtggaactaggctgtgtgaagttcccgccagaggaggcactctacggcctgtggcagcacaacaaggagcccctgttgaacttcctagagatggtgcaccggggcatcaagggtgtggtgacggacaaatatggaaagccagtcaaaaacgcgaggattctagtgaaaggcatccgccatgatgtcaccacagcccctgatggtgactattggagactccttcccccgggttcccatatcgtcattgctcaggcccctggctactccaaggttatgaagagagtcaccattcccttgcgcatgaggagggccggccgcgtggacttcatcctccagcctctaaggacaggacctaagaacttccttcctggaccttcaagagcttcaccctggtcccaaaattcacagggggaggctgcacagctggattttgagccccccagggcacgtaggcagccagctagtgggagcaagccgtggtggtggtcttacttcacatcactgaccccatacaagccacgatggctgctcaagtactagcaccccctcaggccctgccttgatgtccacctccagcctggacttctggttctggagtctcctggccacgggcattacacacagcctctgcagtttattaaaacgcgttcacccac

SEQ ID NO: 17 - DNA, 7885 bp, Artificial sequence
  Synthetic
ccgccgccgcccggagtgcggagccgctggagcggagcggtgtcagcggcgctgctggaagatggcgagcggccgggatgagcggcagccctggcggctgggacgcctgcggctgctgccatcgccaccgctgctgctgctgctgctgctactgaggagttcggcccaggccgcgcacatcaagaaggctgaggcgaccacgacggccgtcgccggctccgaggcggccgagggccagttcgaccactactaccacgaagcggcgctgggcgaggcactggaggcggcggcggccgcggggccgcccggcctggcgcgtctcttcagcatcggcagctcggtggagggccggccgttgtgggtgctgcgcctcacggccggcctggggccgccgcccaccgccgccgcggggctggacgccgcgggccgctgctgcccggccggccgcaggtgaagctggtgggcaacatgcacggcgacgagacggtgtcgcgccaggtgctggtctacctagcccatgagctggcgtccggctaccgccgtggggacccgagactggtccgcctgctcaacatcaccgacgtgtatttgctgcccagcctgaatcccgatggcttcgagcgctcccgcgagggcgactgcggcctcggcgacagcggctcgcccgggaccagcggccgctacaacagccgaggccgcgacctcaaccgcagcttcccggaccagttcagcacaggcaagcccccttccctggatgaggtgccagaggtgcgcgcccttatcgactggatccgcaagaacaagtttgtgctttctggaaatctgcatggtggctcagtggtagcaagttatccttttgatgactctcctgatcatatggccactggaatctatagcaaaacctctgatgatgaagtctttagatacttggcaaaagcttatgcttctaaccaccctataatgaaaactggtgaaccccactgtccaggagatgaagacgagactttcaaagacggcatcacaaacggtgcacactggtatgatgtggaaggtggtatgcaagattacaattatgtgtgggccaactgttttgagatcacattagaattgtcttgttgcaagtaccctcctgcttctcagcttcgacaagaatgggagaataatcgtgagtctttgatcacattgattgaaaaggtccacattggaattaaaggatttgttaaagattcagtaacaggagctgggttagagaatgcaaccatctcagtggctggtattaatcataatatcacaactggaagatttggtgatttccatagattgctcattcctggaatttacaatcttacagcagtttcaactgggtatatgccattgactattcataatataagggtgaaagagggaccagccacagagatggatttttcccttcgaccaactgtgacttcaaaagttcctgactcaactgaggctgtagcaactcctggtacagttgctgtccctaatattcctcctggaacatcatcctcccatcagccaattcagcctaaagactttcaccaccaccatttccctgatatggaaatcttcttgagaagatttgccaacgaatatcctaatatcactcgtctttattctctgggaaagtcagtggagtcaagagaactgtatgtgatggagatatctgataacccaggtgtccatgaaccaggggaaccagaatttaagtatattggaaatatgcatggaaacgaagtggttggaagagaactgctactaaatctcatcgaatacctttgcaagaactttggaacagaccctgaagtaaccgatttggttcgcagcactagaattcaccttatgccatccatgaatcccgacgggtatgaaaagtcccaggaaggagactcagtaagtgtagttggcagaaacaacagcaacaactttgacctaaaccgaaatttcccagaccagtttgttacaatcacagatcctacccaaccagagaccatcgctgtgatgagctggataaagtcctatccatttgtactgtcagccaatctgcatggaggttctttggtggttaactatccttttgatgataatgaacaaggagttgctacatacagtaaatcaccagatgatgctgtgtttcaacaaatagcactttcttattccagggaaaattcccagatgtttcaaggtagaccttgcaaggatatgagtatccttaatgagtattttcttcatgggataacaaatggagctagttggtataatgtaccaggtggtatgcaggactggaactatttacagacaaattgcttcgaagtaactattgaactaggttgtgtaaaatacccatttgagaaagaactgccaaagtactgggaacaaaatcgaagatctctaattcagttcatgaaacaggttcatcagggtgtcaaaggatttgtccttgatgccacagatggtaggggcatattaaatgctaccctcagtgttgctgaaattaatcacccagtaactacttacaaagctggagattattggcgcctcttggtcccggggacttataaaatcacagcatctgctcgagggtataaccccgttaccaagaatgtgaccgtcaggagtgaaggtgctattcaggtcaacttcacacttgttcgatcttcaacagatgcaaacaatgaatcaaagaaaggaaagggggctagcaccagcactgatgattccagtgacccaactaccaaagagtttgaagcattaatcaaacacctttctgctgagaatggtttagaaggcttcatgttaagctcgtcctcagacctggctctgtatcgataccattcatacaaagacttatccgagttcctgagaggacttgtaatgaactacccacacattacaaatcttaccactttgggacagagtgctgagtatcgtcacatttggtccctcgaaatctccaataaacccaacgtatcagaacctgaagaaccaaagattcgttttgttgctggtatccatggaaatgctccggttggaactgaactgcttttggctctggcagaatttctttgcctgaattacaaaaagaacccagttgttacccaattggttgacaggactagaattgtgatcgtaccttctctaaatccggatggacgagaacgagcacaagagaaagagtgtacctcaaagattgggcaaacaaatgcccgtggcaaagacctggacacagacttcacaagtaatgcttcccaacctgagaccaaagccatcattgaaaacttgattcaaaaacaggatttcagcctttctattgctttagacggtggttctgtactggtcacatatccctatgacaagccagtccagacagtggaaaataaagaaactttaaagcatttggcatctctttatgcaaataaccatccatcgatgcacatgggtcagcccagttgcccaaataagtcagatgagaacattccaggaggagtaatgcgtggagcagaatggcacagtcatctgggcagcatgaaggattatagtgttacctatggccattgcccagaaatcactgtgtatacaagctgttgctacttccctagtgcagctcaactccctgccttgtgggcagagaacaagaggtctctccttagcatgttggtagaggtccacaaaggagtccatgggttagttaaagacaagactggtaaaccgatctctaaagcagtcattgtacttaatgatggaataaaagtgcacacaaaagaggggggttatttccatgtgcttttagctcctggtgtccataacatcaatgccatcgctgaagggtaccagcagcagcattcacaggtctttgtacatcatgatgcagccagttctgtgctaatagtctttgatacagataaccggatatttggtttgccaagggaactcgtggtaactgtatcaggtgccacaatgtcagcattgatcctaacggcttgcatcatttggtgcatctgctccatcaagtctaacagacacaaagatggcttccatcggctgcgacagcaccatgatgagtatgaagatgaaatccgaatgatgtctactggctccaagaagtccctcctaagccatgagttccaggatgaaacagacacagaggaggaaacgttatattctagcaaacattgaaaaccatgttttgcatatgtccctgcataaacaccaagtaaaatgacagctcctcttgggagacactgcagtaagaagagggattccttccttcctcaaagagctttgggaagtgaacctgctaagtgcatattctctgaataccataggcagttctgaacttccctcccttaaagtactcttatccttttctaaaaatctgatttctatttatgcagcagaagatgggacagccactttattttcctttctaatttaagatgagctgttcagagcttatgtagtgacagcataaagccatctagtagatgttgtattttgcacatcaggtggctttcgtttttgtttctctttactttaaaggccaaaagaatccagaaacattaaggcagggacaccagtcagactctgacataaagctttaaaaacttgagatttttctccatctactgagttctcttctccagttagcaaatagctggggtttctcttattcaggtaatggaggctggatgattcttaaacatatatgacattaggaaacggaataagcgggcttccgtatttgtctttctacctgtttccaagctggatcagaactggtgggctgtgctgtagcagggttttactacctctcttgtagggttatcaaagctctcaataccctcatcttaaggggaactcactggctttgctatggaggcgccaggggtcctgtgagtagaagtgagagggagatagagcagaaatgaggacgtgcctgtcttaactcgggaaaacccacaggtgctgctgctttatctgtgaagcaccccttcttctaggaatcctgttccttaatgtttcctaaatctcagccccttccgtgttgtacgcctacggttcccagatgatcccacacctaaaggtcctgaattctactgatgaaaatatctaggagtggaagagacctacttgtacattcttaatacatttggatccataatgtctacacttgatgctccagcccaagccttcaccctgtgatgaaaatactgtggctatgtgcatacaggcctccacaagtcctgattcctttgacggtccttttttttttttctaaatcaagcaattatgttaaaattttcagttcaaagcttttaaatatggctccctccatttaaaaaaagtcaactgaaggactgccgtgtgatgggacagtggtgtgaaggtgtcctcttcactgccagtcaggcaaagacctgaaagatttgcattttattgtgtctcttaatgctgttcagtggaatgatctttttgtaagtgagtcttaccaatgacgtaacagtttaatatctttgaatgttttaatggccaagttgctgctgaacttgtactaaatcaggggatcaaaaaactagctcttacctttccaaactgtattgataccattaatttatcagttaccccaaagcctcagctcacctaggtcgctcagccactctttgtgaggaatgcaccaccgagtggctgtacgaaatggagatcctggttagtagaaaggagtaatgagatcatgacatttgttagctgtggtcagttaggtggcttaggttcggccactctggaatcagcgctggcattaccaggtctgaatccctgttttgccacagggacagaatagttcgtggaagttaatactaatgacgggcacatggtttcatttcttccaataacactttgtgtttttctaaatgatgtgtattgctctttttcagctttatttttaaaagtgccaagtcagaaaaccaacaaggggcttatggctgggccctgcttgggacattacagctggaaaccaagttcatgtgacagcctttgctttactagcattggtgttcactgaaggactcctttccacttgttctccggaattaagtgtctttaacagtacatctcagcagtcagaggccatgccttttaaaggatgtgtgaaagttttagagataaatatacagaatagttctcttagtcgttttgttttctgaaatgaaacccaaattctaagtctgtaatgaacttctaatgcattaagctggaaaccagccctccccaccctctgttacctatgaacatgaatgtatgggatccatgactgctaagactgtgttcttacccctgccttcttttatgcgtggatctaatctaatcttggaccactttggcagcagagggcaatgaagccatatgggatggggaatgcatttcttcagtgtttctcctggagactttccatttctctagagtcatggacccaacttagtgtcacagtgttaggacatttgccccagtctgagatgtgccttccctttgctcacaaggcattgttttgtcctggtgatgagcttacaagccttcttccctccctgctccttaataaaagaacatgagtggtaggtaatgtttaaagtgtctgcctgtgaggatgcgcttgtactagtaaagattggcaagcttttgttgtatctggtggaactctgggtggtgatgggatctatccagtgaagagcacttgccatcctcactgaagggaactggctttgggactcttgtcagtctcgaggaaggatacattgtatttttggttcagtgtgcttggttgatcttggtgatttcatctgaatgagatttgctgaattagtgaatattaaatttaaaaccaattatgagtggaaaaataaaaaggtagtgcttatgtctgaactggctgtgtttttcagcgagcaccaggttaccagtaaccaagacttgctcctccgttcatttccactcattctcagcactaaatagttctgttgtcttgttgtactcacacttgtgtcaggttttgtccctgctctcttagaagtttcttggctatgaatatgtcatggtgtccttctgtgtaggtctctggtgggattgttttacagtagcagcccagcatttcccccaattttttcctttattattacgaaaattccactaatggttaaatattcattgatctttctatatagcaacttgttaataactttaggtttctggtttgttttaattttagcagttttggggggagggtgattaggatgtttgattaatgtcaattgaatttggatttctagttcttgaagaaaaccctcccaacacccacttctcctttaatttagaaaaaaaaattcattaatggttccactgactctcagaaatctctcctagttgattttgaaatttgaaagtaggttaccattttgaggcaattggacaaaaattatgtaaatatagacaaatacaatgtttataaatggcataacatgaatgtactagctacgttctgtgctgcagattttttggaggtatgacatggaatttttttatgttattttcaccactctgctttttttcagaatgataactccccagctccaaaactgtccatagctatttctgtgacatgcctaatactcattcatcttaagtgctcagtcttttgttttagttcatgcactgtgccttcaaaatgaaaattttaaaagggactttaaaagaatagtagttttaaaagttaatctgtgtaatttatgtgaaatctaactataatgaggtcctttgtttttatatgtaaacagatctactaatcctgtataaaagttattttatgatgtttgtc

SEQ ID NO: 18 - DNA, 2495 bp, Artificial sequence
  Synthetic
gactcgggcgggctgcggggctccggatcgcgctgcgcggccccgaggggccaccttcacctcgcatctctgaagagggagcgtggagctcaggacatggacctcgcgcgcctgtggctggggcttcagctgcccctagtagccgccctggatttccgataccaccaccaggaagggatggaagcgttcctaaagagcgttgcccagaactacagttccatcacgcacttacactgcatcgggaaatctgtgagaggtagaaacctgtgggttcttgttgtggggaagtctccaaaggaacaccgaattgggattccagaattcaaatacgtggctaatatgcatggagatgagaccgtggggcgagaattgctgctccacctcatcgactacctggtgaccaatcacgggaaagatgccgaaatcacacaactaatcaacagcactcggatccacatcatgccttccatgaacccagatggatttgaagccgtcaagaagcccgactgttattacagtaacggaagggaaaattacaacaattatgacctgaacagaaactttcctgatgccttcgaaaataataacgtgacacagcagcctgagaccctggcagtcatgaagtggctgaaaaccgagacatttgtcctctctgccaatctccacgggggtgccctggtggccagctaccccttcgataatggtgtgcaagccacggggacactgttgtcccgaagcctaactccagatgacgatgtttttcaacacctcgcatatacctacgcttcccggaaccccaatatgacaaaaggagatcagtgcaaaaacaaaaggaacttccccaatggaattactaatgggtactcctggtatccactgcaaggtggaatgcaagattacaactacatctgggcccagtgttttgaacttacattggagctgtcatgctgtaaataccctcgagaagaaaagctaccagtgttttggaatgacaacagagcctctttgattgaatatataagacaggtgcacctaggtgtaaaaggtcaagtgtttgaccagagtggaaatccattgccgaatgtaattgtggaagtccaagacagaaaacacatctgcccatatcgaaccaacaaacttggagagtactacctgcttcttttgccagggtcctacgtgatcaatgttacagtccctgggcatgacccgcacctcacaaagctgactatcccaaggaattcccagaccctcggtgctcttaaaaaggatttccacctcccgtttcgagtgcaactggattccatcctcgtatcagatctttcgtgcccaatggttcctctgtataaactaaggccaaaccacacagctgcaacaaagcctactttgtatgtattcctcttgactcttttgcacatatttttcaaataaagtcaaatgtgaaactcaagccccatcaccacctggaatcagggattggttactccaggtgatggcaactgtccctcttacgagactgccatgggataaacaccactgttttccctaaggggaaaactggatgtttccaaacccagctgagagcagcatccgatgacaaaagtgatcttcagtctggatgattggaggtcactgcctagcaagtgccgcctacatgaaactccatcctgaaatagaaccagaaatttgcaagaaacttgagaagcaaaacagacatccctagaaggaaaaaaaaaaaaagttaattttgtatacagaaaggccaatggatctgagcagcgatgatgaacacttcctgatcacctactatgtgtgaccatgccatgagtgctctttgtgaagaactaacaccacgtagaagtggctctccctaaaggaagagattcctaggtaaccggactgagagcactgacttttccagtgttctaaggagaagtgagaggaaatgggcaaacatgcctgaagtgaaatggcctctgtctccggtgccaatgtccttgcctccctgcacccgatgccacagtccgaccaagatgacacctcgtatgtaatcctagcctcatgctggagtcccagatgctcagcaagctgctcactggacacgcccactcggatatgacccgtatgaacttgacctcatcctattgacagttgagataccacgcgaaggctggtcctgcttcgtgagtccccgttgacgctttcttcgttttgggtatccagccagtgagtcactgaaagctgctgtgttgatgcatcctgtcctctccacacgagtgattccccctcaccgctgacccagcgccaccgtctcttgctcatgggtatctctttgccaggtccatcttccacacagtactggaggaggggggctgcccaaaagcccttccgctccctaaacacaaggcggtgctcgccgtcccagatctgtgtgccattctgattgtgccacatctgtttcccactcagtaaaactccattccaagtaccttcttcaa

SEQ ID NO: 19 - DNA, 2045 bp, Artificial sequence
  Synthetic
atgcatgccaatagtcccagctctcatgatgctgaggcaggatgtttctctgttccattagctgttttctttcttgccccggcccgcggggctccgaccagcgtccgtcgcaatccggcgagcagactttttgtcggtgtgcactaccgaggtttccttggggcaggggtctccattccgacgaagaatccgtacctcgagccgcacgtttgggcgccacctgccccggcccgcggggctccgagccctgccatcagcaggatctacacggtggggcgcagcttcgagggccgggagctcctggtcatcgaactgtccgacaaccccgggatccatgagcccggtgaacctgaatttaaatacattgggaacatgcatggcaatgaggctgttggacgagaactgctcattttcttggcccagtacctgtgtaatgagtaccagaaagggaatgaaaccattgtcaacctgatccacagtaccagaattcatatcatgccctccttgaaccctgatggctttgagaaggcggcgtctcagccaggtgagctgaaggattggtttgtaggccgcagcaatgcccagggaatagatctgaaccggaactttccagaccttgataggatcgtgtatgttaacgagaaagaaggtggccccaataaccatctgctgaagaatctgaagaaaattgtggatcagaacgcaaagcttgctcccgagaccaaggctgtcatccactggattatggacattccctttgtgctctccgccaatctgcatggaggagaccttgtggctaattacccatatgatgagacgaggagtggtaccgctcatgagtacagttcctgtcccgatgatgcaatattccaaagcttggctcgagcatactcctctttcaacccagtcatgtctaaccccaatagaactccctgtcgaaagaacgacgatgacagtagttttgtagatggaacgaccaatggtggtgcatggtacagtgtaccgggtgggatgcaagacttcaattacctgagcagcaactgcttcgagatcactgtggagctcagctgtgagaagttcccacctgaagagactctccaaagctattgggaagacaacaaaaactccctcatcagctacctggagcagatacaccgaggagttaaaggatttgtccgtgaccttcaaggtaacccaattgccaatgcaaccatctccgtggatgggatagaccacgatgttacttcggccaaggatggggattactggcgattgcttgcgcccggaaactacaaacttacagcttcagctcctggctacctggcaataacaaagaaagtggcagttcctttcaagcctgctgttgcggttgactttgagctggagtcgttctctgaaaggaaagaggaggagaaggaagaattgatggagtggtggaaaatgatgtcagaaactttaaatttttaagaaaggcttctaactaatcgctttaatctatctatataacgtagtgagatgcaatgtggctcttttattttagattgtgtgcagttaatatttaacactgatttactttaaatcatttaagtagtaattgatattacttaaatatactcagacaaaaaacataaggtctcgatctacttcagtctcattagcatttgcctccccacatagctttaaaatatagctcttttaatttcattggtgacaatgtcccatgaaaaagccaacagatgtagcctggagttgtgagcactgcactgcaagaattacatagttctgtatcagttgtcatttgtctctcgtgctgactcgctgtataagcatgatcttgttaatgcacttctgctgggaagaaaatgtacgtgtttcaaaatggctttaggcagaacgaaaacctacttctggactgtactttataaagagtggtcttgtcttattagtcagcctgttaaggccagtccagagtttggggttttgtattgattgcagattggcccagaattgcattgtgaatgaataaaggttaaaaaattccatga

SEQ ID NO: 20 - DNA, 3914 bp, Artificial sequence
  Synthetic
cttccaaaaggttttctaggcttacgagagggagagaaatgagcccgggaggcatcgtggttatcccagggccacagaaataatccccagcgttgtcgcagacaccggtgcccagtctcctgcaggtgtggcaggtgcgaggcagggcctggccgctcttggctctggatcccgactagcagaggatttctaggagagctggaggcacttcagagccgctgggaagctccgagagatgccagacataccttcagccttcctgcccctcctccttctctccaggttagttgcccctgtgacctttcgtcaccaccgctatgatgacctcgtgcggacactatacaaggtacacaaccaatgcccggacatcacgcggctctacaacatcgggcgcagcgtgaaggggaggtacctctacgtgctggagttcagcgaccacccgggaatccatgagcccttggaaccggaagtcaagtatgtgggtaacatgcacgggaatgaggtgctgggccgtgagctgctgctgcagctgtcggagttcctttgtgaggagttccggaaccggaaccagcgaatcctgcgcctcatccaggacacgcgcattcatatcctgccctccatgaaccccgacggctacgaggtggctgctgcgcagggcccaaatgcatctgggtatctggttggcaggaacaacgcaaacggagtggacctgaaccgcaacttccccgacctcaacacctacttctactacaacgagaagtatggcggccccaaccaccacttacccctcccagacaactggaaaagtcaggtggaacccgagaccagggccgtgatccagtggattcgctccctaaacttcgttctgtcggccaatctgcatggcggggctgtggtggccaattacccatatgacaagtccctgttccgaagtcctcaccgcacctccaattcccccacaccagatgaccagctcttccagacgctggccaaggtctactcctatgcccatggatggatgcaccaaggttggaactgcggtgattacttcccagacggcatcaccaacggggcgtcctggtactctctcagtaagggaatgcaagactttaattatctccacaccaactgctttgagatcacactagagctgagttgcaacaagtttccccgccaagaggagctgcagcgggagtggctgggtaaccgggaagccttaatccagttcttggaacaggttcaccagggcatcaagggaatggtgcttgatgagaactctaacaacctcacaggggctgtcatttccgtcagtgggatcaatcacgatgtcacttcaggtgaacatggggattacttccgtctgctgcttccgggtacttacattgtcactgccaaggcaccagggtatgaccccaaaacagtgactgtgacagtggggcctgcgggaccagcactggtcaacttccaactcaatcgaagcacgtctcaggtgcaccctgcgcagaaagctcccggccgaggacaaggaagcaggccaaagcagccccggataaccagaaagaaagacacggcaacaaagcggcatcgaggtcctgcctgaagcccagcacccagggcctcacacagcaaggccgggtccctcctctcaaatcccatggccatgcttctcttgtattatctgggacatattcagacacaggcacatgcagaacaggtccaagtgtttctgcctcccctaggccagtattaaaggagtcggaaccttccggaaactggtgccccactgtacatgcctccataggttagaattaaaggtcagaactttccagaaactggtaccccactgcacatgcctccagcagggttctggagaccttcttcctgagagtctgggttgggtcccatgccagtgtgcactgcatgccgagacaggttccagctggttgtcagtctgtctccagagtctagtgtggagctgctgacaacttggtgctgcatgaagctgtcaaaatgtctgcagccctgagggggatccagaattgcctgggaccatttccacaatagccagtgtattcctagtaagggaagggtgtgacccacggggttcagttccctgcccctcttctgtgaacactgccaacaatttacacctttcctgatattttccgggtatgtaggagacatggtacacctgtacttttgtatgtgctggcagcgtgtcctgcaggacagtgctctgggctttgctgagtcccagccgaacccactggtcctgaaggcattattgagcatgctagatgtttctgaagacattgtgtagtcttccatctcatgcctactagcatagaagctgatgagcccagagtcctctgtccccagtgctgggtgttaggggtcagcctgagtttccacagccgctccactaaccaacctagctttttcttgtgcatgagcaatcttctccctcacctcgtggggcatagccccacacacatcagcagctgtgaagatgtggcctgtcccgtgaactaacattccttcttgatctatgtttgagccatctcagtctggccaaaaggaaaagagactaaggtgtagcctctccatcttagagatgtctctcttcaagctaaaagattaatgctttctttgcagttgccaattttaattccttggatcccttctaatggagcagctttgagagggcacagcttagatcagtgacacatggtgccttcatttattattatgtacgctacattttctagagtgtctgaatatcactctttgttcaggtttcccaatactaagtcatttgacagaactgatgtttacaaaatggggtcacagagtacttgctggcactgcccctgactttccttccttccttccttccttcatactatggatctttactgagtccctgctcacaaagggtgcagagattgcaaagaggaaggaagcctggcccatggtctcagtgtggtaatgcagcccggaagacccatgcattgtcataattgctgtgaccccataactctgaggtagggctgaggagcctgtgagaaaagcccagcacagcaatagtgaggcctgatataagatacactgaaatcaacagtgacccctgaggtaagtttgctgaagtcagacagagcgaggtgtagaggcgtaggggtgcttagtctcagaaggtggcaagagcagagccctggagcttcttggaaggttgtgggtcctgtgggggtggggaggctacaagaaacacagcatttgggactgagcgagatgttgagagccaaggctgggtgtctgggagggacctatacacagggtaatttggcctttctccccagaagacccaggagctactgaagggttccgccaatggctggcctgaacttggttgttagctagggctgctgcctaaagagcttgcagataggagcctgcagggagccagctgggaagatggcctcagccttggaggggcagtggcctagagagcatttccgatcagctccttgtgacttccctaccttcccagagactttgagtttcctcactcagctctcttgtgtctgcaaaactgaggccgaaatactaaagcacttcaccccaaccataaggcctgtcctgagtataccctgctcaagggcaaagttgtgagattaaaccacattacacagaatacccaggctctggccatggcacagaaactccatgtatcctgaaggaaagctgtggattgtatacagtttagtgtacgtccctccaggttcgtgcactggaagcttggtccccaggcgggtggtggcactggggcaatggaagctgtaaggggtggggcctaatacaagataggtcgtgagcccctgccctccaaataaatcagcgctgacctcctggtgtaa

SEQ ID NO: 21 - DNA, 2917 bp, Artificial sequence
  Synthetic
tcccaaagaaaccctcgatagacgaagatgatggaggttctcggacctcagagtcccctgccagttgcttcggcttcgttgcttactctgtgaaccctggagacaaatcacgggttaaggttaaatcctaccagcccactcactgcagtacctccccctccgaactctctgggtcccccacaccatcgccattgccctcgcccagaaagctccgttgcttggaccagcgagataccgagtcggaggagaggcaagatcaagagagacaagatcaagagaggcacgaatacaaaaagaagcttagagagggcaaccaacactgtacatttaattctctgtggctaggagcaccttccaccatggccacctcagcaagttcccacttgaacaaaaacatcaagcaaatgtacttgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgcagagatcccaacaagctggtgttctgtgaagttttcaagtacaaccggaagcctgcagagaccaatttaaggcactcgtgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggaattccaaataggaccctgtgaaggaatccgcatgggagatcatctctgggtggcccgtttcatcttgcatcgagtatgtgaagactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccggtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagaccgccgcccctctgccaattgtgacccctttgcagtgacagaagccatcgtccgcacatgccttctcaatgagactggcgacgagcccttccaatacaaaaactaattagactttgagtgatcttgagcctttcctagttcatcccaccccgccccagctgtctcattgtaactcaaaggatggaatatcaaggtctttttattcctcgtgcccagttaatcttgcttttattggtcagaatagaggagtcaagttcttaatccctatacacccaaccctcatttcttttctatttagctttctagtgggggtgggaggggtaggggaagggaacgtaaccactgcttcatctcatcaggaatgcatgtccagtaggcagagctgccacagagcgggtgtatttgtggaggaggactttttcttcaggacagttaaaagagcaggtccactgcttggattgacaattcccctataggtagagagctgctagttcttcaggtaaaaccaactttctattccaaatggaagttaggtgaggagtagtgggaggagttcatgccctccatgaagacagctcagtgtatcacctgacagatgggtagccctactgtaaaagaaggaaaagttatttctgggtcctccatttataacacaaagcagagtagtatttttatatttaaatgtaaaaacaaaagttatatatatggatatgtggatatatgtgtatttctaattgaggaaaccatcctagtcactgggtttgccaagtttgaagagcttggttaacaagaaaggatctcttgagtagaggtgggggtgcagtaccaggaaaggtggttatctggggctcagcgctttattactatgtggggtttccctgcccactctgcaggagcagatgctggacaggtagtagggtgggacaccagtgcttgccaccacctgtccctgtgcttaggctaagatgcatatgtatccacatagagttagcaggatggagttggctggtcaacttgaacattgttactgataggggtgggtggggtttattttttggtgggactagcatgtcactaaagcaggccttttgatatattaaattttttaaagcaaaacaagttcagcttttaatcaactttgtagggtttctaactttacagaattgcctgtttgtttcagtgtctccttccactttgctcttggaggaacggaggacaggcagacctggagttaaaacatttgtcattttgtgtcatagtgtctactttctcccagcagaatattcctttccttcttaggagtcctatggagttttgtttttgttttttttctattacgataaacataccccacctccattctggcttgccctgctgttctctggttgtttgtgtgctgtccgcagcaggctgcctgtggttttctcttgccatgacgacttctaattgccatgtacagtatgttcagttagataactcctcattgtaaacagactgtaactgccagagcagcgcttataaatcaacctaacatttataaga

SEQ ID NO: 22 - DNA, 1327 bp, Artificial sequence
  Synthetic
tgtcatggttcgaccgctgaactgcatcgtggccgtgtcccagaatatgggcatcggcaagaacggagattttccctggccaatgctcaggaacgaattcaagtacttccaaagaatgaccaccacctcctcagtggaaggtaaacagaacttggtgattatgggccggaaaacttggttctccattcctgagaagaatcgacctttaaaggacagaattaatatagttctcagtagagagctcaaggaaccaccacaaggagctcattttcttgccaaaagtctggacgatgccttaaaacttattgaacaaccagagttagcagataaagtggacatggtttggatagttggaggcagttccgtttacaaggaagccatgaatcagccaggccatctcagactctttgtgacaaggatcatgcaggaatttgaaactgacacgttcttcccagaaattgatttggagaaatataaacttctcccagagtacccaagggtccttcctgaagtccaagaggaaaaaggcatcaagtataaatttgaagtctatgagaagaaaggctaacagaaagatacttgctgattgacttcaacttctactgctttcctcctaaaattatgcatttttacaagaccatgggacttgtgttggctttagatctatgagttattctttctttagagagggatagttaggaagatgtatttgttttgtggtaccagagatggaacctgggatcctgtgcatcctgggcaactgttgtactctaagccactccccaaagtcatgccccagcccctgtataattctaaacaattagaattattttcattttcattagtctaaccaggttatattaaatatactttaagaaacaccatttgccataaagttctcaatgcccctcccatgcagcctcaagtggctccccagcagatgcatagggtagtgtgtgtacaagagaccccaaagacatagagcccctgagagcatgagctgatatgggggctcatagagataggagctagatgaataagtacaaagggcagaaatgggttttaaacagcagagctagaactcagactttaaagaaaattagatcaaagtagagactgaattattctgcacatcagactctgagcagagttctgttcactcagacagaaaatgggtaaattgagagctggctccattgtgctccttagagatgggagcaggtggaggattatataaggtctggaacatttaacttctccgtttctcatcttcagtgagattccaagggatactgcagagacagaacaagaataggctgcttctacc

SEQ ID NO: 23 - DNA, 7981 bp, Artificial sequence
  Synthetic
gtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctctagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtggttttcttttgccatgacaacttctaattgccatgtacagtatgttcaaagtcaaataactcctcattgtaaacaaactgtgtaactgcccaaagcagcacttataaatcagcctaacataagatctctctgatgtgtttgtgattctttcaaatccctatgtgccattatatttctttatttcctaaaacaggcaaaataagctcaagtttatgtactctgagtttttaaaacactggagtgatgttgctgaccagccgtttcctgtacctctctaagttgggtatttgggacttaagggattaagtttttcacctagacttagttacacacaatcttggcatttcctagcctagaggtttgtagcagggtacaagccccactcctcccccttcctttgctcccctgagtttggttttggcttaccataacattgttttgaccattcctagcctaatacaatagcctaacataatgtaagattaactggctttacgatttctattctctgctctcagtgataagaaacaaatattagctaccctgctaccctggttgaagccttccaaggctggctatgccctaggcatgggctcatccttgggtgtatcttgccttgcaggaagaccagtggaccgattgtgattctcaaaagctctgtgttgtcacctgtgcccttgccccttgctcttatcttggtccgtgtatctgggagttcttccaccttatcttggccaattcctaccttcgttcattcctcatgaggttgggtaaaagctccctccggctcccatgatgctgtgcatatacctagcaaaaagcaattattggacacattggagtgcaatattattaatagcattaatactactaataatgtgggcaatagtgattgtttttaaaaggcagtatactcttaccagtgcgaggtagctggggcctgtgatagtttttagagataagttcttcaggcaactgtgtattttacactagtcaagtaatcctagatatccgtggtttttcttaagaaagttggctcgtaatatgatttaatattcaaagtagagtcatctacctattagcttgctggcgtggtcctagtttatgcctgtttcagcatgattgttgagtaccctgtttcatccttagcattttcttgattttgttgttaaatgatgtatacccttatttccattgaatctgtgcttccacccccccaactgaagttgtcttccctttgcttggccacccttacagcctcttggatggtgtatcctacagtgtaagcactaaactgaagaggcagtgacctgagcactttggattttgttcattgtaatcaattccatgacaaaatgattgcatgagaaggaattttaaattcataggatcagaatttaggtgaaaacaaccagcatatttgtttcttcaccctctcacctagaattagctttgacctacaggtcacagtgcaatccccttgtatttctaaggtgttttttatagttcatttgcagacaatgggttatgtgataacttttatcagtgatagattaaacagaataatgaccaagctttcaaccttaaggagtcaggccagtatttacaaaaggaggtctccatgaactccttaaatatgagttcccctaatatcatcttgccaggtactaaataacaactgatagcacaagctatagggaatttgaaagaattccatggatgggtgttgtctagggccttttgttgtttttgagacggggtctgactctcacccaggctggagtatagtgtggcgcaatcttggctcactgcaacttctgcctcccagattcaagcgattctcctgcctcagcctcccaagtagctgagactacaggtgtgcaccaccatgctcagctaatttttgtatttttagtacagatggggtttcaccatgttggccaggctggtcttgaactcctgatctcccaaagtgaggtcttgaactggtcttgaactcctccacctcccaaagtgctgggattacaggcgtgagccactgcacccggcctagggccatgtaaaaagccagatctgtgctgctgtctgtgtagaagggtagacaagtggatgagaagttcctgaactattcttggcccttttaccactaagtgaaagtaacttgctgccccaaagaaagatgtctcatcattcgacaggactttctagttgaacttcatgaaagcaagagatcctgtttttcttgctcaccactgtatcttgagacctgttgtagtgcctgcaatacttatttaataagttatttttaagtatcagttttgtgagctttaactctatgaggtctttgttgtttgactgtattttaactctggccatgacagcaagacaaagttccatttttattgagcttaaaaagaatcaaggccaggtgaagtggcttacgcctgtgatcccaacactttgtgaggctgcagcaggaggatctcttgagcccaggagtttgagaccgttctaggcaatgtagtgaggtccagactccacaaaataatttttttttaaattgcacgcctgtagtctcagctatcaggaggctgagatgggaggatgacttgagcccaggaaattgaagctgcagtgaattgtgattgcaccactgcactccagcctgggtgacagatcaagaccttgcctaaacaaaacaaaacaaacaaaaccccaaaaaacaaattgaaaatgttgattctttttactacaaacattatggcagcactaaaaacttcgtgggagtgtactgtggaaaatagtgtacttaattaattctcattgtaatcaggctaccaagagccttgtgttgctttaagagttataactgccaggcacagtggctcatgcctataatcccagcaccttgagaggccgaggcaggtggatcacctgagatcgggagtttgagaccagccgggccaatatggtgaaacaagctgtgtctctactaaatacaaaaaattagccgggcgtggtggcacatgcctgtaatcccagctgcttgggagactgagacaggagaattgcttgaacctggaaggcggaggttgcagtgagctgagattgcaacattgtactccagcctgggcaacaagagggaaactccatctcaaaaaaaaaaaaaaagttgtaactgaggctgggcatggtggctcatacctgtaatcccagcactttgaaaagccgaggcaggtagatcacttgagctcagaagttcgagactagcctgggcaacatgacaaaaccccatctctacaaaaaatacgaaaaattagctgggcgtggtggcatgcacctgtagtcctagctacctgggaggctgaggtgggaagattacttgaagctgcagtgagccatggttgtgccactgccctccagtctgggcaacaaagtgagaccctgtctcaaaaaaacaaaaaaaaattataactgatgtaaactggcagtttaggctgggtgtggtggctcaagcctgtaatcctagcactttgggaggccaaggcaggtggatcacctgagttcaggagttcgagaccagcgtggccaacatggtgaaaccttgtctctattaaaaataccaaaattagcaagatgtggtggtgggtgcctataattccagctactcaggaggctgaggcaggaggatcgctggagccagggaggcagaggttacagtaagcaaagatcactccacttcactccagcctgggcaaaagagtgagacatatcaaaaaataaacaaataaataaataaataagtggcagttcatcatttaactccaaagactttgcgtacatttctactgaaaacaatctgagctgattagaaccctgccattttatagcctttagctcgatctccgaccgttcatttaaaaaaattctacttcaggccgggcatggtggctcaagcctgtaatcccatcactgtaggaggccaaagtgggcagatcacttaaggtcaggagtttgagaccagcctggccaccatggtgaaaccccatctctactaaaaatacaaaaattagccgggcttggtggtgagcacctgtaatcccaccctgccgagtggcaggctgaggcaggagaatcgcttgagcccaagagccggaggttgcagtgagccaagcttgcaccattgcactccagcctaggcaacagagtgtgactccatctcaagaaaaaaaaaattctatttcattttacaatatgcagatatatgtccatacacatgcataatataaatgtataccatatttgtgagaatatgcatatatgtacacattagatacacaatacaagcacaatacatatgtcttttgcccaagatacagcattttgtaaaggagacaggaatttagtaatatatgttccagaaacagtacacaagagaattcgccgagatgagaaagttgtcactaggaatggggagtggtaagatgtagaaggtataattgttcttaaagttctactgccaactctttccaattaattacccactctgccatgctttatggacaggaggttgtcggacactgtcaattaataaatatttgagcatgatacactgcttggagctcctctaatataggagagtgatatcctagtgcatgttacagagggagtgtccacacagttcctattgtcatttgatgagttacttttcaggggccttgtacctgagcaagttgtcctctttttgatggatttcagattgagttacctgcattgtcttgagattgcagcgtgtttcctccactgtacggcgtagtcagcagatctattagttaaactccagtgggccctcagtcactaaatctatcctctgtgttgaaggctttctgcatttgcctttcaataaaggtttagaataactccttaaaaaa

SEQ ID NO: 24 - DNA, 4076 bp, Artificial sequence
  Synthetic
ctcttcttcttaaacaaaccacaaacggatgtgagggaaggaaggtgtttcttttactcctgagcccagacacctcactctgttccgtctaagcttgttttgctgaacacttttttttaaaaaaggaaaaagaaaaggagttgcttgatgtgagagtgaaatggacgtaagattttatccacctccagcccagcccgccgctgcgcccgacgctccctgtctgggaccttctccctgcctggacccctactattgcaacaagtttgacggtgagaacatgtatatgagcatgacagagccgagccaggactatgtgccagccagccagtcctaccctggtccaagcctggaaagtgaagacttcaacattccaccaattactcctccttccctcccagaccactcgctggtgcacctgaatgaagttgagtctggttaccattctctgtgtcaccccatgaaccataatggcctgctaccatttcatccacaaaacatggacctccctgaaatcacagtctccaatatgctgggccaggatggaacactgctttctaattccatttctgtgatgccagatatacgaaacccagaaggaactcagtacagttcccatcctcagatggcagccatgagaccaaggggccagcctgcagacatcaggcagcagccaggaatgatgccacatggccagctgactaccattaaccagtcacagctaagtgctcaacttggtttgaatatgggaggaagcaatgttccccacaactcaccatctccacctggaagcaagtctgcaactccttcaccatccagttcagtgcatgaagatgaaggcgatgatacctctaagatcaatggtggagagaagcggcctgcctctgatatggggaaaaaaccaaaaactcccaaaaagaagaagaagaaggatcccaatgagccccagaagcctgtgtctgcctatgcgttattctttcgtgatactcaggccgccatcaagggccaaaatccaaacgctacctttggcgaagtctctaaaattgtggcttcaatgtgggacggtttaggagaagagcaaaaacaggtctataaaaagaaaaccgaggctgcgaagaaggagtacctgaagcaactcgcagcatacagagccagccttgtatccaagagctacagtgaacctgttgacgtgaagacatctcaacctcctcagctgatcaattcgaagccgtcggtgttccatgggcccagccaggcccactcggccctgtacctaagttcccactatcaccaacaaccgggaatgaatcctcacctaactgccatgcatcctagtctccccaggaacatagcccccaagccgaataaccaaatgccagtgactgtctctatagcaaacatggctgtgtcccctcctcctcccctccagatcagcccgcctcttcaccagcatctcaacatgcagcagcaccagccgctcaccatgcagcagccccttgggaaccagctccccatgcaggtccagtctgccttacactcacccaccatgcagcaaggatttactcttcaacccgactatcagactattatcaatcctacatctacagctgcacaagttgtcacccaggcaatggagtatgtgcgttcggggtgcagaaatcctcccccacaaccggtggactggaataacgactactgcagtagtgggggcatgcagagggacaaagcactgtaccttacttgagaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaaaataaaaagtattcccaagtgattttaatttaaaaacaaattggctttgtctcattgatcagacaaaaagaaactagtattaagggaagcgcaaacacatttattttgtactgcagaaaaattgcttttttgtatcactttttgtgtaatggttagtaaatgtcatttaagtccttttatgtataaaactgccaaatgcttacctggtattttattagatgcagaaacagattggaaacagctaaattacaacttttacatatggctctgtcttattgtttcttcatactgtgtctgtatttaatctttttttatggaacctgttgcgcctatttatgaaataataaatataggtgtttgtaagtaaatttgttagtatttgaaagaggtttctttgatgttttaacttttgctggcaaaaaaaaattcacgcttggtgtgaatactttattatttagtttttacagtaacatgaataaagccaaacctgcttttcatttagcagcaaattaaagtaaccagtccttatttctgcatttctttggttgatgcaaacaaaaaactattatatttaagaactttatttcttcatacgacataacagaattgccctccaagtcacacaagctccaagactaaacaaacagacaggtcctctgtcttaaaaaggttacttcttggttctcagctggttctagtcaattctgaaccaccaccccccgccccccgcaaaaaagtaaaagtcaaaccaaacttcctcaagctgcatgcttttcacaaaatccagaaagcatttaagaattgaactaggggctggaagaagtgaaagggaagcatctaaaaatgaaaggtgagtaaccagatagcaaaagaaaagggaaagccatccaaatttgaaagctgttgatagaaattgagattcttgctgtcttttgtgcctctacaagctactactcattccagaattcctgggtcttccaagaggattcttaaggtaccagagatttgctagggaaccaaaagtgcttgagaatctgcctgagggcttgcatagctttcacattaaaaaaagaaaaagctagcagatttactcctttttaggggatcatatcaagaaagttagtctggttggaaaccaagagaatggctgatgtctctttcttggaatatgtgaaataaatttagcagtttaactaaatacaaatatatgcattgtgtaatccactcagaattaaacagacaaaaggtatgcttgctttggaatgattttaggcattgtacaaccttgaatcacttgagcatgtaataactaataaataatgcagatccatgtgattattaaaatgactgtagctgagagctctaattttcctgtcttgaaactgtataagaactcatgtgattaagttcacagtttattgtttgtctgtttagtattttagaaatataccagcactactaattaactaatgtcttttatttattatattatgataaagtaaaaatttcacttgcattaagtctaaactgagaaggtaattactgggaggagaatgagcagctttgactttgacaggcggtttgtgcaggaaagcacagtgccgtgttgtttacagcttttctagagcagctgtgcgaccagggtagagagtgttgaaattcaataccaaatacagtaaaaacaaatgtaaataaaagaaaacacatcatcaataaaactgttattatgcgtgaccgta

SEQ ID NO: 25 - DNA, 596 bp, Artificial sequence
  Synthetic
gaatctgaacacctcttctttccactgaggaattcagggaagtgttttcaccatggattgctttgtacagtcaaggcagttctccattttattagaaaatacaagttgctaagcacttaggaccatttgagcttgtgggtcacccactctggaagaaatagtcatgcttctttattatttttttaatcctttatggacattgtttttcttcttccctgaaggaaatttggaccattcagattttatgttggttttttgctgtgaagtgctgcgctctagtaactgccttagcaactgtagatgtctcggataaaagtcctggattttccattggttttcataatgggtgtttatatgaaactactaaagactttttaaatggcttgatgtagcagtcatagcaagtttgtaaatagcatctatgttacactctcctagagtataaaatgtgaatgtttttgtagctaaattgtaattgaaactggctcattccagtttattgatttcacaataggggttaaattggcaaacattcatatttttacttcatttttaaaacaactgactgatagttctatattttcaaaatatttgaa

SEQ ID NO: 26 - DNA, 2414 bp, Artificial sequence
  Synthetic
ctctttctctgctgattatgcagcagactcgcacagaggctgtcgcgggcgcgttctctcgctgcctgggcttctgtggaatgagactcgggctccttctacttgcaagacactggtgcattgcaggtgtgtttccgcagaagtttgatggtgacagtgcctacgtggggatgagtgacggaaacccagagctcctgtcaaccagccagacctacaacggccagagcgagaacaacgaagactatgagatccccccgataacacctcccaacctcccggagccatccctcctgcacctgggggaccacgaagccagctaccactcgctgtgccacggcctcacccccaacggtctgctccctgcctactcctatcaggccatggacctcccagccatcatggtgtccaacatgctagcacaggacagccacctgctgtcgggccagctgcccacgatccaggagatggtccactcggaagtggctgcctatgactcgggccggcccgggcccctgctgggtcgcccggcaatgctggccagccacatgagtgccctcagccagtcccagctcatctcgcagatgggcatccggagcagcatcgcccacagctccccatcaccgccggggagcaagtcagcgaccccctctccctccagctccactcaggaagaggagtcggaagtgcatttcaagatctcgggagaaaagagaccttcagccgacccaggaaaaaaggccaagaacccgaagaagaagaaaaagaaggaccccaatgagccgcagaagcctgtgtcggcctacgcactcttcttcagagacactcaggccgccatcaagggtcagaaccccagtgccactttcggtgacgtgtccaaaatcgtggcctccatgtgggacagcctgggagaggaacagaagcagagctccccagatcaaggtgagaccaagagcactcaggcaaacccaccagccaaaatgctcccacccaagcagcccatgtatgccatgccaggcctggcctccttcctgacgccgtcggacctgcaggccttccgcagtggggcctcccctgccagcctcgcccggacgctgggctccaagtctctgctgccaggcctcagtgcgtccccgccgccgccaccctccttcccgctcagccccacactgcaccagcagctgtcactgccccctcacgcccagggcgccctcctcagtccacctgttagcatgtccccagccccccagccccctgtcctgcccacccccatggcactccaggtgcagctggcgatgagcccctcacctccagggccacaggacttcccgcacatctctgagttccccagcagctcgggatcctgctcacctggcccatccaaccccaccagcagcggggactgggacagcagctaccccagtggggagtgtggcatcagcacctgcagcctgctccccagggacaaatcgctctacctcacctaatcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttataataaaacttctgaaaagctgaaaa

SEQ ID NO: 27 - DNA, 905 bp, Artificial sequence
  Synthetic
tcccgcctccctaccatccctgaggctcgctggaaggcactgctcagagcctgaagggctgacagcagaaaagaggccctggccagaggcagggtggcccatcggagagagcagtgacacacccattgcccgggggctgagtctcttcctcaacctcccaccagactctgcagaggcagcccactgcccaccaccagcccaaagaacctgcaggaaccttccgcccgctgacctgcttgctccagggtaactgtggaccctgtcctcgccctgcgcacggtaccctatgtctggacacccggccccagctccagccccagcccaggtgggccgcccctggcggggtcgcttaccaacggacacccaccccagatgcatgggccagagggccggcccccggcatagatgtgcacatcggttttccagtgtgaacaaaagattacgaaacctagaaactgttggttccgtgtaagtagttgactacgtgttttagaactgtgctgaagacatctgtaagactattttgtgggggaaaaaagtagtttcctttaaggtaaaaagcattttatatgatccttagcacatttttaagttttatcttaagggagacgcgcacaaaagcggctgccaaaccgtttcgtcatcctcacagcaaggaccggacgcttgctagccaccccggagcactgctctccttttaatcatgtattcatctattttaaattgccggcgacgacttttgtctatttatgaagaaaccttgagaacgaagttacagcttatcctaccgtgtgtgtggttttggggtttcgtttgggtttgggttcttgacgtcgtttgcagctgtttcctggccctggcgagtgtctgtcttggtgcccagtgcttctctcaaatctctttat

SEQ ID NO: 28 - DNA, 2097 bp, Artificial sequence
  Synthetic
gctcacctccgcctgagcagtggagaaggcggcactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggccagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattataattaaatatgagagcatgctaa

SEQ ID NO: 29 - DNA, 1152 bp, Artificial sequence
  Synthetic
ccggcttccttggccaccagtgttctgcagaccctccaccatgagcccgggtcagcgcatttcctcaggagaagcaggcagggtgcaggccattgcaggccgtccaggggctgagctgcctgggggcgaccggggctccagcctgcacctgcaccaggcacagccccaccacaggactcatgtctcaatgcccacagtgagcccaggcagcaggtgtcaccgtcccctacagggagggccagatgcagtcactgcttcaggtcctgccagcacagagctgcctgcgtccagctccctgaatctctgctgctgctgctgctgctgctgctgctgcctgcggcccggggctgaaggcgccgtggccctgcctgacgccccggagcctcctgcctgaacttgggggctggttggagatggccttggagcagccaaggtgcccctggcagtggcatcccgaaacgccctggacgcagggcccaagactgggcacaggagtgggaggtacatggggctggggactccccaggagttatctgctccctgcaggcctagagaagtttcagggaaggtcagaagagctcctggctgtggtgggcagggcaggaaacccctccacctttacacatgcccaggcagcacctcaggccctttgtggggcagggaagctgaggcagtaagcgggcaggcagagctggaggcctttcaggcccagccagcactctggcctcctgccgccgcattccaccccagcccctcacaccactcgggagagggacatcctacggtcccaaggtcaggagggcagggctggggttgactcaggcccctcccagctgtggccacctgggtgttgggagggcagaagtgcaggcacctagggccccccatgtgcccaccctgggagctctccttggaacccattcctgaaattatttaaaggggttggccgggctcccaccagggcctgggtgggaaggtacaggcgttcccccggggcctagtacccccgccgtggcctatccactcctcacatccacacactgcacccccactcctggggcagggccaccagcatccaggcggccagcaggcacctgagtggctgggacaagggatcccccttccctgtggttctattatattataattata

SEQ ID NO: 30 - DNA, 1997 bp, Artificial sequence
  Synthetic
gctttctattcaagtgccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttccgga

SEQ ID NO: 31 - DNA, 1123 bp, Artificial sequence
  Synthetic
gaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaatta

SEQ ID NO: 32 - DNA, 2237 bp, Artificial sequence
  Synthetic
atttggagagttaaaactgtgcctaacagaggtgtcctctgacttttcttctgcaagctccatgttttcacatcttccctttgactgtgtcctgctgctgctgctgctactacttacaaggtcctcagaagtggaatacagagcggaggtcggtcagaatgcctatctgccctgcttctacaccccagccgccccagggaacctcgtgcccgtctgctggggcaaaggagcctgtcctgtgtttgaatgtggcaacgtggtgctcaggactgatgaaagggatgtgaattattggacatccagatactggctaaatggggatttccgcaaaggagatgtgtccctgaccatagagaatgtgactctagcagacagtgggatctactgctgccggatccaaatcccaggcataatgaatgatgaaaaatttaacctgaagttggtcatcaaaccagccaaggtcacccctgcaccgactcggcagagagacttcactgcagcctttccaaggatgcttaccaccaggggacatggcccagcagagacacagacactggggagcctccctgatataaatctaacacaaatatccacattggccaatgagttacgggactctagattggccaatgacttacgggactctggagcaaccatcagaataggcatctacatcggagcagggatctgtgctgggctggctctggctcttatcttcggcgctttaattttcaaatggtattctcatagcaaagagaagatacagaatttaagcctcatctctttggccaacctccctccctcaggattggcaaatgcagtagcagagggaattcgctcagaagaaaacatctataccattgaagagaacgtatatgaagtggaggagcccaatgagtattattgctatgtcagcagcaggcagcaaccctcacaacctttgggttgtcgctttgcaatgccatagatccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 33 - DNA, 1270 bp, Artificial sequence
  Synthetic
atccaaccaccttatttttgagcttggtgttttgtctttttcagaaactatgagctgtgtcacctgactggttttggaggttctgtccactgctatggagcagagttttcccattttcagaagataatgactcacatgggaattgaactgggacctgcactgaacttaaacaggcatgtcattgcctctgtatttaagccaacagagttacccaacccagagactgttaatcatggatgttagagctcaaacgggcttttatatacactaggaattcttgacgtggggtctctggagctccaggaaattcgggcacatcatatgtccatgaaacttcagataaactagggaaaactgggtgctgaggtgaaagcataacttttttggcacagaaagtctaaaggggccactgattttcaaagagatctgtgatccctttttgttttttgtttttgagatggagtcttgctctgttgcccaggctggagtgcaatggcacaatctcggctcactgcaagctccgcctcctgggttcaagcgattctcctgcctcagcctcctgagtggctgggattacaggcatgcaccaccatgcccagctaatttgttgtatttttagtagagacagggtttcaccatgttggccagtgtggtctcaaactcctgacctcatgatttgcctgcctcggcctcccaaagcactgggattacaggcgtgagccaccacatccagccagtgatccttaaaagattaagagatgactggaccaggtctaccttgatcttgaagattcccttggaatgttgagatttaggcttatttgagcactgcctgcccaactgtcagtgccagtgcatagcccttcttttgtctcccttatgaagactgccctgcagggctgagatgtggcaggagctcccagggaaaaacgaagtgcatttgattggtgtgtattggccaagttttgcttgttgtgtgcttgaaagaaaatatctctgaccaacttctgtattcgtggaccaaactgaagctatatttttcacagaagaagaagcagtgacggggacacaaattctgttgcctggtggaaagaaggcaaaggccttcagcaatctatattaccagcgctggatcctttgacagagagtggtccctaaacttaaatttcaagacggtataggcttgatctgtcttgcttattgttgccccctgcgcctagcacaattctgacacacaattggaacttactaaaaatttttttttactgtt

SEQ ID NO: 34 - DNA, 2603 bp, Artificial sequence
  Synthetic
ttcctggtgtaagctttggtatggatggtggccgtctccctacagactgggagctgttagagggcagggatcctagctgacacatctatgtcctcgccttggttggaggcctccaccatggacagaggccaggccctgcccctcccaggcagcctggctccttctgctgggccctgaaggcagacgggataatgtggttggccaaggcctgttggtccatccagagtgagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactgaaaaaaaaaaaaaa

SEQ ID NO: 35 - DNA, 533 bp, Artificial sequence
  Synthetic
cccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattg

SEQ ID NO: 36 - DNA, 3472 bp, Artificial sequence
  Synthetic
aagccacataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcggcagagttgaatgaatgaagacagacgcggagaactcctaaggaggagattggacaggctggactccccattgcttttctaaaaatcttggaaactttgtccttcattgaattacgacactgtccacctttaatttcctcgaaaacgcctgtaactcggctgaagccatgccttgtgttcaggcgcagtatgggtcctcgcctcaaggagccagccccgcttctcagagctacagttaccactcttcgggagaatacagctccgatttcttaactccagagtttgtcaagtttagcatggacctcaccaacactgaaatcactgccaccacttctctccccagcttcagtacctttatggacaactacagcacaggctacgacgtcaagccaccttgcttgtaccaaatgcccctgtccggacagcagtcctccattaaggtagaagacattcagatgcacaactaccagcaacacagccacctgcccccccagtctgaggagatgatgccgcactccgggtcggtttactacaagccctcctcgcccccgacgcccaccaccccgggcttccaggtgcagcacagccccatgtgggacgacccgggatctctccacaacttccaccagaactacgtggccactacgcacatgatcgagcagaggaaaacgccagtctcccgcctctccctcttctcctttaagcaatcgccccctggcaccccggtgtctagttgccagatgcgcttcgacgggcccctgcacgtccccatgaacccggagcccgccggcagccaccacgtggtggacgggcagaccttcgctgtgcccaaccccattcgcaagcccgcgtccatgggcttcccgggcctgcagatcggccacgcgtctcagctgctcgacacgcaggtgccctcaccgccgtcgcggggctccccctccaacgaggggctgtgcgctgtgtgtggggacaacgcggcctgccaacactacggcgtgcgcacctgtgagggctgcaaaggcttctttaagcgcacagtgcaaaaaaatgcaaaatacgtgtgtttagcaaataaaaactgcccagtggacaagcgtcgccggaatcgctgtcagtactgccgatttcagaagtgcctggctgttgggatggtcaaagaagtggttcgcacagacagtttaaaaggccggagaggtcgtttgccctcgaaaccgaagagcccacaggagccctctcccccttcgcccccggtgagtctgatcagtgccctcgtcagggcccatgtcgactccaacccggctatgaccagcctggactattccaggttccaggcgaaccctgactatcaaatgagtggagatgacacccagcatatccagcaattctatgatctcctgactggctccatggagatcatccggggctgggcagagaagatccctggcttcgcagacctgcccaaagccgaccaagacctgctttttgaatcagctttcttagaactgtttgtccttcgattagcatacaggtccaacccagtggagggtaaactcatcttttgcaatggggtggtcttgcacaggttgcaatgcgttcgtggctttggggaatggattgattccattgttgaattctcctccaacttgcagaatatgaacatcgacatttctgccttctcctgcattgctgccctggctatggtcacagagagacacgggctcaaggaacccaagagagtggaagaactgcaaaacaagattgtaaattgtctcaaagaccacgtgactttcaacaatggggggttgaaccgccccaattatttgtccaaactgttggggaagctcccagaacttcgtaccctttgcacacaggggctacagcgcattttctacctgaaattggaagacttggtgccaccgccagcaataattgacaaacttttcctggacactttacctttctaagacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatgaataaatattacaaattctaaaagataagtgtgtttgcaaaaaaaaagaaaataaatacataaaaaagggacaagcatgttgattctaggttgaaaatgttataggcacttgctacttcagtaatgtctatattatataaatagtatttcagacactatgtagtctgttagattttataaagattggtagttatctgagcttaaacattttctcaattgtaaaataggtgggcacaagtattacacatcagaaaatcctgacaaaagggacacatagtgtttgtaacaccgtccaacattccttgtttgtaagtgttgtatgtaccgttgatgttgataaaaagaaagtttatatcttgattattttgttgtctaaagctaaacaaaacttgcatgcagcagcttttgactgtttccagagtgcttataatatacataactccctggaaataactgagcactttgaattttttttatgtctaaaattgtcagttaatttattattttgtttgagtaagaattttaatattgccatattctgtagtatttttctttgtatatttctagtatggcacatgatatgagtcactgcctttttttctatggtgtatgacagttagagatgctgattttttttctgataaattctttctttgagaaagacaattttaatgtttacaacaataaaccatgtaaatgaa

SEQ ID NO: 37 - DNA, 606 bp, Artificial sequence
  Synthetic
gacctcctcccaagcacttcaaaggaactggaatgataatggaaactgtcaagagggggcaagtcacatgggcagagatagccgtgtgagcagtctcagctcaagctgccccccatttctgtaaccctcctagcccccttgatccctaaagaaaacaaacaaacaaacaaaaactgttgctatttcctaacctgcaggcagaacctgaaagggcattttggctccggggcatcctggatttagaacatggactacacacaatacagtggtataaactttttattctcagtttaaaaatcagtttgttgttcagaagaaagattgctataatgtataatgggaaatgtttggccatgcttggttgttgcagttcagacaaatgtaacacacacacacatacacacacacacacacacacagagacacatcttaaggggacccacaagtattgccctttaacaagacttcaaagttttctgctgtaaagaaagctgtaatatatagtaaaactaaatgttgcgtgggtggcatgagttgaagaaggcaaaggcttgtaaatttacccaatgcagtttggctttttaaattattttgtgcctatttatg

SEQ ID NO: 38 - DNA, 5604 bp, Artificial sequence
  Synthetic
gcgcagccgggagagcggagtctcctgcctcccgccccccacccctccagctcctgctcctcctccgctccccatacacagacgcgctcacacccgctccctcactcgcacacacagacacaagcgcgcacacaggctccgcacacacacttcgctctcccgcgcgctcacacccctcttgccctgagcccttgccggtgcagcgcggcgccgcagctggacgcccctcccgggctcactttgcaacgctgacggtgccggcagtggccgtggaggtgggaacagcggcggcatcctcccccctggtcacagcccaagccaggacgcccgcggaacctctcggctgtgctctcccatgagtcgggatcgcagcatcccccaccagccgctcaccgcctccgggagccgctgggcttgtacaccgcagcccttccgggacagcagctgtgactcccccccagtgcagatttcgggacagctctctagaaactcgctctaaagacggaaccgccacagcactcaaagcccactgcggaagagggcagcccggcaagcccgggccctgagcctggacccttagcggtgccgggcagcactgccggcgcttcgcctcgccggacgtccgctcctcctacactctcagcctccgctggagagacccccagccccaccattcagcgcgcaagataccctccagatatgccctgcgtccaagcccaatatagcccttcccctccaggttccagttatgcggcgcagacatacagctcggaatacaccacggagatcatgaaccccgactacaccaagctgaccatggaccttggcagcactgagatcacggctacagccaccacgtccctgcccagcatcagtaccttcgtggagggctactcgagcaactacgaactcaagccttcctgcgtgtaccaaatgcagcggcccttgatcaaagtggaggaggggcgggcgcccagctaccatcaccatcaccaccaccaccaccaccaccaccaccatcaccagcagcagcatcagcagccatccattcctccagcctccagcccggaggacgaggtgctgcccagcacctccatgtacttcaagcagtccccaccgtccacccccaccacgccggccttccccccgcaggcgggggcgttatgggacgaggcactgccctcggcgcccggctgcatcgcacccggcccgctgctggacccgccgatgaaggcggtccccacggtggccggcgcgcgcttcccgctcttccacttcaagccctcgccgccgcatccccccgcgcccagcccggccggcggccaccacctcggctacgacccgacggccgctgccgcgctcagcctgccgctgggagccgcagccgccgcgggcagccaggccgccgcgcttgagagccacccgtacgggctgccgctggccaagagggcggccccgctggccttcccgcctctcggcctcacgccctcccctaccgcgtccagcctgctgggcgagagtcccagcctgccgtcgccgcccagcaggagctcgtcgtctggcgagggcacgtgtgccgtgtgcggggacaacgccgcctgccagcactacggcgtgcgaacctgcgagggctgcaagggctttttcaagagaacagtgcagaaaaatgcaaaatatgtttgcctggcaaataaaaactgcccagtagacaagagacgtcgaaaccgatgtcagtactgtcgatttcagaagtgtctcagtgttggaatggtaaaagaagttgtccgtacagatagtctgaaagggaggagaggtcgtctgccttccaaaccaaagagcccattacaacaggaaccttctcagccctctccaccttctcctccaatctgcatgatgaatgcccttgtccgagctttaacagactcaacacccagagatcttgattattccagatactgtcccactgaccaggctgctgcaggcacagatgctgagcatgtgcaacaattctacaacctcctgacagcctccattgatgtatccagaagctgggcagaaaagattccgggatttactgatctccccaaagaagatcagacattacttattgaatcagcctttttggagctgtttgtcctcagactttccatcaggtcaaacactgctgaagataagtttgtgttctgcaatggacttgtcctgcatcgacttcagtgccttcgtggatttggggagtggctcgactctattaaagacttttccttaaatttgcagagcctgaaccttgatatccaagccttagcctgcctgtcagcactgagcatgatcacagaaagacatgggttaaaagaaccaaagagagtcgaagagctatgcaacaagatcacaagcagtttaaaagaccaccagagtaagggacaggctctggagcccaccgagtccaaggtcctgggtgccctggtagaactgaggaagatctgcaccctgggcctccagcgcatcttctacctgaagctggaagacttggtgtctccaccttccatcattgacaagctcttcctggacaccctacctttctaatcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatggaaataaaaaggaggcagtcatgttagcaaatgacacgttaatatccctagcagaggctgtgttcaccttccctgtcgatcccttctgaggtatggcccatccaagacttttaggccattcttgatggaaccagatccctgccctgactgtccagctatcctgaaagtggatcagattataaactggattacatgtaactgttttggttgtgttctatcaaccccaccagagttccctaaacttgcttcagttatagtaactgactggtatattcattcagaagcgccataagtcagttgagtatttgatccctagataagaacatgcaaatcagcaggaactggtcatacagggtaagcaccagggacaataaggatttttatagatataatttaatttttgttattggttaaggagacaattttggagagcaagcaaatctttttaaaaaatagtatgaatgtgaatactagaaaagatttaaaaaatagtatgagtgtgagtactaggaaggattagtgggctgcgtttcaacattccgtgttcgtactcccttttgtatgtttctactgttaatgccatattactatgagataatttgttgcatagtgtccttatttgtataaacatttgtatgcacgttatattgtaatagctttgcctgtatttattgcaagaccaccagctcctggaagctgagttacagagtaattaaatggggtgttcacagtgacttggatacaccaattagaaattaaataagcaaatatatatatatatataaatatagcaggttacatatatatatttataatgtgtctttttattaaccatttgtacaataaatgtcacttcccatgccgttattttatggttcatttgcagtgacttttaaggcagtactgtttagcactttgatattaaaattttgcttatgttttgctaaattcgaataatgtttgaagatttttaggtctaaaagtctttatattatatactctgtatcaagtcaaaatatctttggccattttgctaagaaacaaactttgaatgtcaaactgatgtcacagtagtttttgttagctttaaatcatttttgctttagtctttttaaaggaaaataacaaaactatgctgtttatattgtcattaaattatacaatcaaacaaatgccaaatgaattgcctaattgctgcaaagtataacccagataggaaatcatatgtttttttccaagagtcattctaatatttgattatgttatgtgtgcttttatgaaagattgttatttttatatatcaagatgatagaacctggaatgttaggattttgaaatgttagacttggaaggggcctggtctgtcaactagtccaaccccttaaaattcatagaggagcaaactggggcccattgaagggtgaagagttactcaaggtcaaacagctggtaacagaatcaagactaagacctaatttacctttccatactctttttttttctcaacttcatctatataaaatcaggcttttaaacataaccactaatatttacctgaagataaccatgagtaaagtatacttttgcattaattttttgagcttatatgcaaacataataaatattattaaatatcaggaaagctaacatttcatacaagatagcttcagaccaaattcaaattgaatttgaataaattagaaatactgtgcatacataaccttcttgtgcaccatgagtatttggaaagttaatccttgtttttgtcgtgtctataaaggaagaacaaaacaaaataaaaacagagccctagagaaatgctgttactttttatttttacacccatcagatttaaggaaaagactttttagccattataatctagtggttggaaggaatgaagaagcttttttagtaataggtccagatatgagtgctaaaaataaagatgatagcatgttcttctgtcttccatagttattacaactatgagagcctcccaagtcatcttatcaactcaactcccttttttttgtcttaatgttgcacataagtttatacagagtggatgaccacactagcacagaagagaacaacatgtattaaagcaggtgattcctccccttggcgggagagctctctcagtgtgaacatgccttctgtgggcggaaatcaggaagccaccagctgttaatggagagtgccttgcttttatttcagacagcagagttttccaaagtttctctgctcctctaacagcattgctctttagtgtgtgttaacctgtggtttgaaagaaatgctcttgtacattaacaatgtaaatttaaatgattaaattacattttatcaatggc

SEQ ID NO: 39 - DNA, 669 bp, Artificial sequence
  Synthetic
tcaggagcagtggagcagtgagctgcctcctctcctagcacctgcttgctacgcagcaaagggataggtttggaaacctatcatttcctgtccttccttaagaggaaaagcagctcctgtagaaagcaaagactttcttttttttctggctcttttccttacaacctaaagccagaaaacttgcagagtattgtgttggggttgtgttttatatttaggcattgggggatggggtgggagggggttatagttcatgagggttttctaagaaattgctaacaaagcacttttggacaatgctatcccagcaggaaaaaaaaggataatataactgttttaaaactctttctggggaatccaattatagttgctttgtatttaaaaacaagaacagccaagggttgttcgccagggtaggatgtgtcttaaagattggtcccttgaaaatatgcttcctgtatcaaaggtacgtatgtggtgcaaacaaggcagaaacttccttttaatttccttcttcctttattttaacaaatggtgaaagatggaggattacctacaaatcagacatggcaaaacaataatggctgtttgcttccataaacaagtgcaattttttaaagtgctgtcttactaagtcttgtttattaactctcctttattctatatgga

SEQ ID NO: 40 - DNA, 7431 bp, Artificial sequence
  Synthetic
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtcctggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagccgcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatacccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaaaagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctcttttaaataaacagaatgccagtaagaggttgacccctaccatggaacttctgggatgctaaatacttcctcatgaacaaaataagttccttattataagttccttatactagcagcttcacctaaagaattttctctccagcaatattgacttcactggggaaaagccaagagtgtgtggtgagtgatttgttctcactcgacctggctaggactggctaggagctgttttttgtacatgagggaatttgggctttcctcagttatctgaatgttttacccaagtgccttcctgctattgtagcaaagtagctcagcttccttgtccacagggtgaaaaaggactaatgcattttccatcagttttctaactatgttagcaaaaacggcctcctggtagctcaacctcctgtacgcgtgtgtgtgtgtaatacacacacaaataaacccctctgtttttctaagacatcttagctggatattataggaagcactttcataaacaactgtaacaaatcgcaaaggaaagagaaacaaaagcattagatttgagacataaacaggcaagagaaagtgtattaggaactgacagctatcaaggaagttttgtcagttacaaatgctaggaggaaattttgccaagaaggatggctcatgaaatatttccagtacgggaagaggcaataagatcctctaagagaatgagaaagtaggggtgtctaaatggtaaagatgggtgtgttgcacgtgtgttagaaggatctcagttgagtgaaggtttgcactgctacatctaagttaatgtaaatatgtagcactctgacaggtctaccgtgttgctgaatgtagtatatttccaaagtttgcaagtcttcctgtattgtacaaagatgctgctgcttgataatatgtatagcaatccagattagtatgttattaaattttattttcttacctgtatttttatgctttttacctgtcctcaaaatattacacccctgttggaattagatttatatttataaatggtcagaaatctttttaagtgtctctttttacacataggttgatttttttttcttaagagaaatgatgtattcttgaaacatttgttactcattccaggaaacaaaaacccatataataaaacccccactcagagcctgttagtcacctctctagaagatggcatctcaggagaaggaatggctttgtggaagaaggaatcacctttttcttgctcaagaattatgctgacttcagccctgagcctggatctggtcactgagaatcatcaagtgtctagatcctccccccaaaataactaatttagtaggtgattttgattttaaaaaattgacaccaaaaccctgcctgcattgtaatggaattcgaaaagaattcatgttcacagaactcaacgttcaggctaatatttacagaagggaccaaatctaaatcctggtagataactcctgtatgctttatccaaaggacacccacagttttccagcatagatataaccaaggatgaattgattccttcaaagaactgggaggcacggatattgcattttttgtttacatccagtagccaagacgcctcagtgagccagtcttgggcagaggctgtcacatttaggcagattggaagttggtatgttctaattctcactctggactacagtgaggctgaatttatcatgtcaaaaaaaaaaaaaaaaaaagacctttccaagtgctttctattgctcagaattgaaagaatgttttcatttcaagtttacaagaggcatggatggagttgtgacgttcttgacaagctgggctaacctttcccgaacttgtttcccggaggcaaggtgctcggtgacccagcgcatcttaaccttgggtctcctaggctcgaggctagggcattacgtttcgtggaaccaaagcagccaattgcatagcaagtattttcctgcattccaattaaatgcttaagaaaaagcagcatcctataaaattgtgatcataaacatccatttccctcagcttttgtgagtgccttgacttacagccaacatcactgtttaactcagtctgtttaaaaacaaacttttctggtggttgataacagagagttgctccctgagccatcagggtcctgggagctggaagtgaaagggttattaacattctacctttatgcagctgttggctgaccagaataaactccctgctgagttcaagctttgaatggaatggatgcaaatgatgttgtttccattagagcaggtgctcacagcattctgattggcctgagcagaccgaggctatggctgttgggacaagcttagcatcctggacatcttgtcaaagaacctcactcacccctctggcctctacagccctcagaggagagaaaaccaattctccaacaaacaggtctctccaacatggtggtgctggcaggcttaggtttagaaaatcctgactgttaaaggcgtttgaatacatcacattcctatgcaaatgtttttaatctccagtttaatgtagtttatttttcctatatgtaaagtatttttatacggcttgtatcatgatagtttagcaataaaacagttggaagcaa

SEQ ID NO: 41 - DNA, 1815 bp, Artificial sequence
  Synthetic
aagaagccattatagcaagacaccttctgtatctgacccctcggagccctccacagcccctcaccttctgtctcctttcatgttcatctcccagcccggagtccacacgcggatcaatgtatgggcactaagcggactctcacttaaggagctcgccacctccctctaaacaccagagagaactcttcttttcggtttatgttttaaatcccagagagcatcctggttgatcttaatggtgttccgtccaaatagtaagcacctgctgaccaaaagcacattctacatgagacaggacactggaactctcctgagaacagagtgactggagcttggggggatggacgggggacagaagatgtgggcactgtgattaaaccccagcccttgcgttcgtttttccaggtcacagatacagctcctgtaccttttgaaggcaaggagttctcagagcaaccaaaggaacgtgacccaagagcccagcttacaggctgaagaaacccaaaaccctcgatagagacagaaactgaactgtcagtccttagagctcgcccagtccatgccacaactgggccacagctaaagctttatttttgaattctcattccaaaaccaaactgtcttgcccagacaagatcacctgttaagacttcttggcgttaagttatgacatgtatacgcgtttgttattattattttttctgctttaaaaggctgaccagggcacctagccctggagctgtcttggcgagctgttctttaacccctgcagcacgcagtcctgctaacacaatttccatagacttggggggctgacccaggctgcagagagcaagcacctgtctgctgcagctgtacaacctggatgctttgcaaggttccggcttgctttcttcctagcagccagagtgcttttccgtaaagcggtggagaatctcaagcatgtgcatttaattgaggaatagcagaagggctaaagcaaccaagaaaagaagtgtgggtatttttgttaagtaaaacagcccaagtgcttctggaggtgggtttctaccaagatagaggaaaagggctgaattccctctaagtgggacagccgagctcaggatgtgcttcccagcttcactggttaatttgacctgaacctatttaaagatcccttctgcccctgaagacctatccgcactcaaattctaacatgaagaaatctactcgaatgcatcctttactttgaatgagctctattcggttgcatgttatatgtgatttccttcctcccaactgtttccactgagcgcacccagtctcccctagtcttcctctgtgggtgtgatttttgtgatttttacaaacaaaacccttgaagttcttggcagatgtgtttgtttctgtttgcatgtactgcagataccccaggacaagcgggggattcatttttcagccattcagttgtttcctcaataatccgcagcaaagtgaaaatattcttagcactcagactgtacttagagtgttttctcagtccagtctgtacagtctgtaggcagaaggcctcagaagaaagtcatggccactcagtgcccactgtgggctttgtaagtcctggctctcccgtcaaggttacccagaggtaaaagcttcctgggagtggggccaggtgtgtttggcactccagatagaaggcaaaatgctcagattcgggcctgtgcacttgtatgcaacctgtcggtcgatacctagcatttatttttccctgacaatgaacgacctttccctcacccaccctaagctcaaagagtttagcaaaattctctttta

SEQ ID NO: 42 - DNA, 3696 bp, Artificial sequence
  Synthetic
ctcttctcccgcgggttggtggacccgctcagtacggagttggggaagctctttcacttcggaggattgctcaacaaccatgctgggcatctggaccctcctacctctggttcttacgtctgttgctagattatcgtccaaaagtgttaatgcccaagtgactgacatcaactccaagggattggaattgaggaagactgttactacagttgagactcagaacttggaaggcctgcatcatgatggccaattctgccataagccctgtcctccaggtgaaaggaaagctagggactgcacagtcaatggggatgaaccagactgcgtgccctgccaagaagggaaggagtacacagacaaagcccatttttcttccaaatgcagaagatgtagattgtgtgatgaaggacatggcttagaagtggaaataaactgcacccggacccagaataccaagtgcagatgtaaaccaaactttttttgtaactctactgtatgtgaacactgtgacccttgcaccaaatgtgaacatggaatcatcaaggaatgcacactcaccagcaacaccaagtgcaaagaggaaggatccagatctaacttggggtggctttgtcttcttcttttgccaattccactaattgtttgggtgaagagaaaggaagtacagaaaacatgcagaaagcacagaaaggaaaaccaaggttctcatgaatctccaactttaaatcctgaaacagtggcaataaatttatctgatgttgacttgagtaaatatatcaccactattgctggagtcatgacactaagtcaagttaaaggctttgttcgaaagaatggtgtcaatgaagccaaaatagatgagatcaagaatgacaatgtccaagacacagcagaacagaaagttcaactgcttcgtaattggcatcaacttcatggaaagaaagaagcgtatgacacattgattaaagatctcaaaaaagccaatctttgtactcttgcagagaaaattcagactatcatcctcaaggacattactagtgactcagaaaattcaaacttcagaaatgaaatccaaagcttggtctagagtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaacattaaattataatgtttgactattatatatgtgtatgcattttactggctcaaaactacctacttctttctcaggcatcaaaagcattttgagcaggagagtattactagagctttgccacctctccatttttgccttggtgctcatcttaatggcctaatgcacccccaaacatggaaatatcaccaaaaaatacttaatagtccaccaaaaggcaagactgcccttagaaattctagcctggtttggagatactaactgctctcagagaaagtagctttgtgacatgtcatgaacccatgtttgcaatcaaagatgataaaatagattcttatttttcccccacccccgaaaatgttcaataatgtcccatgtaaaacctgctacaaatggcagcttatacatagcaatggtaaaatcatcatctggatttaggaattgctcttgtcatacccccaagtttctaagatttaagattctccttactactatcctacgtttaaatatctttgaaagtttgtattaaatgtgaattttaagaaataatatttatatttctgtaaatgtaaactgtgaagatagttataaactgaagcagatacctggaaccacctaaagaacttccatttatggaggatttttttgccccttgtgtttggaattataaaatataggtaaaagtacgtaattaaataatgtttttggtatttctggttttctcttttttggtaggggcttgctttttggttttgtcttccttttctctaactgatgctaaatataacttgtctttaatgcttcttggatcccttagaaggtacttcctttttaaccttaacccttttagtagttaaataattatttccataggttgctattgccaagaagacctcttccaaacagcacatgattattcgtcaaacagtttcgtattccagatactggaatgtggataagaaagtatacatttcaaggggtaggttttattattaagaaagccaaatgaggattttgaaatattctttcctgcatattatccattctagctacatgctggccagtgggccacctttcttttctgcaatttaatgctagtaatatattctatttaacccatgagtcccaaagtattagcatttcaacatgtaagcatgtcggtaagatagttgtgctttgcttagggttccctcctgtgttatggtctggaaagtgtctttaggcagaaagtctgagtgatcacagggttcactcattaatttctcttttctgagccatcatagtctgtgctgtctgctctccagttttctatttctagacagaagtagggcaagttaggtactagttattcttcatggccagaagtgcaagttctactttgcaagacaagattaagttagagaacaccctattccactttggtgaactcagagcaagaactttgagttcctttgggaggaagacagtggagaagtctttgtacttggtgatgtggtttttttcctcatggcttcacctagtggccccaagcatgacttctcccatgtcaatgagcacagccacattcccgagttgaggtgaccccacggtccagaatcatcctcattctggtgaacctggttctctttgtggtgggcatactgggtaggagaatcacccaaaggtcacccatgagctgcagaaaaaaaggctatttgcagaaggagctcacagatcacattgaaagcattgcatattcaaacatcttggtcttctttattggcatgcccacagggtcttctgacctctgattagatcagacactttttagatattgaatcatcagtttctgtacaactatctgaataaggtatataatcaatgaaatttagaatttttttctatgcttactcctgattggtaatttgtttgggtttagaattctatacaaggccatttgtaattttcctcagcactttaaaaatattaaaccatgttttcttaa

SEQ ID NO: 43 - DNA, 628 bp, Artificial sequence
  Synthetic
agtgaaaaacaacaaattcagttctgagtatatgcaattagtgtttgaaaagattcttaatagctggctgtaaatactgcttggttttttactgggtacattttatcatttattagcgctgaagagccaacatatttgtagatttttaatatctcatgattctgcctccaaggatgtttaaaatctagttgggaaaacaaacttcatcaagagtaaatgcagtggcatgctaagtacccaaataggagtgtatgcagaggatgaaagattaagattatgctctggcatctaacatatgattctgtagtatgaatgtaatcagtgtatgttagtacaaatgtctatccacaggctaaccccactctatgaatcaatagaagaagctatgaccttttgctgaaatatcagttactgaacaggcaggccactttgcctctaaattacctctgataattctagagattttaccatatttctaaactttgtttataactctgagaagatcatatttatgtaaagtatatgtatttgagtgcagaatttaaataaggctctacctcaaagacctttgcacagtttattggtgtcatattatacaatatttcaattgtgaattcacatagaaaac

SEQ ID NO: 44 - DNA, 2635 bp, Artificial sequence
  Synthetic
acatctcccggcggcgggccgcggaagcagtgcagacgcggctcctagcggatgggtgctattgtgaggcggttgtagaagagtttcgtgagtgctcgcagctcatacctgtggctgtgtatccgtggccacagctggttggcgtcgccttgaaatcccaggccgtgaggagttagcgagccctgctcacactcggcgctctggttttcgttaataaaggtatccatggagaacactgaaaactcagtggattcaaaatccattaaaaatttggaaccaaagatcatacatggaagcgaatcaatggactctggaatatccctggacaacagttataaaatggattatcctgagatgggtttatgtataataattaataataagaattttcataaaagcactggaatgacatctcggtctggtacagatgtcgatgcagcaaacctcagggaaacattcagaaacttgaaatatgaagtcaggaataaaaatgatcttacacgtgaagaaattgtggaattgatgcgtgatgtttctaaagaagatcacagcaaaaggagcagttttgtttgtgtgcttctgagccatggtgaagaaggaataatttttggaacaaatggacctgttgacctgaaaaaaataacaaactttttcagaggggatcgttgtagaagtctaactggaaaacccaaacttttcattattcaggcctgccgtggtacagaactggactgtggcattgagacagacagtggtgttgatgatgacatggcgtgtcataaaataccagtggaggccgacttcttgtatgcatactccacagcacctggttattattcttggcgaaattcaaaggatggctcctggttcatccagtcgctttgtgccatgctgaaacagtatgccgacaagcttgaatttatgcacattcttacccgggttaaccgaaaggtggcaacagaatttgagtccttttcctttgacgctacttttcatgcaaagaaacagattccatgtattgtttccatgctcacaaaagaactctatttttatcactaaagaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattaggaataaataaaaatggatactggtgcagtcattatgagaggcaatgattgttaatttacagctttcatgattagcaagttacagtgatgctgtgctatgaattttcaagtaattgtgaaaaagttaaacattgaagtaatgaatttttatgatattccccccacttaagactgtgtattctagttttgtcaaactgtagaaatgatgatgtggaagaacttaggcatctgtgggcatggtcaaaggctcaaacctttattttagaattgatatacacggatgacttaactgcatttttagaccatttatctgggattatggttttgtgatgtttgtcctgaacacttttgttgtaaaaaaataataataatgtttaatattgagaaagaaactaatattttatgtgagagaaagtgtgagcaaactaacttgacttttaaggctaaaacttaacattcatagaggggtggagttttaactgtaaggtgctacaatgcccctggatctaccagcataaatatcttctgatttgtccctatgcatatcagttgagcttcatataccagcaatatatctgaagagctattatataaaaaccccaaactgttgattattagccaggtaatgtgaataaattctataggaacatatgaaaatacaacttaaataataaacagtggaatataaggaaagcaataaatgaatgggctgagctgcctgtaacttgagagtagatggtttgagcctgagcagagacatgactcagcctgttccatgaaggcagagccatggaccacgcaggaagggcctacagcccatttctccatacgcactggtatgtgtggatgatgctgccagggcgccatcgccaagtaagaaagtgaagcaaatcagaaacttgtgaagtggaaatgttctaaaggtggtgaggcaataaaaatcatagtactctttgtagcaaaattcttaagtatgttattttctgttgaagtttacaatcaaaggaaaatagtaatgttttatactgtttactgaaagaaaaagacctatgagcacataggactctagacggcatccagccggaggccagagctgagccctcagcccgggaggcaggctccaggcctcagcaggtgcggagccgtcactgcaccaagtctcactggctgtcagtatgacatttcacgggagatttcttgttgctcaaaaaatgagctcgcatttgtcaatgacagtttcttttttcttactagacctgtaacttttgtaaatacacatagcatgtaatggtatcttaaagtgtgtttctatgtgacaattttgtacaaatttgttattttccatttttatttcaaaatatacattcaaacttaaaatta

SEQ ID NO: 45 - DNA, 198 bp, Artificial sequence
  Synthetic
agaaatggttggttggtggttttttttagtttgtatgccaagtgagaagatggtatatttggtactgtatttccctctcattttgacctactctcatgctgcagagggtactttaagacatactccttccatcaaatagaaccactatgaagctacctcaaacttccagtcaggtagttgcaattgaattaaattagg

SEQ ID NO: 46 - DNA, 2344 bp, Artificial sequence
  Synthetic
agacccttgctgcggagcgacggagagagactgtgccagtcccagccgccctaccgccgtgggaacgatggcagatgatcagggctgtattgaagagcagggggttgaggattcagcaaatgaagattcagtggatgctaagccagaccggtcctcgtttgtaccgtccctcttcagtaagaagaagaaaaatgtcaccatgcgatccatcaagaccacccgggaccgagtgcctacatatcagtacaacatgaattttgaaaagctgggcaaatgcatcataataaacaacaagaactttgataaagtgacaggtatgggcgttcgaaacggaacagacaaagatgccgaggcgctcttcaagtgcttccgaagcctgggttttgacgtgattgtctataatgactgctcttgtgccaagatgcaagatctgcttaaaaaagcttctgaagaggaccatacaaatgccgcctgcttcgcctgcatcctcttaagccatggagaagaaaatgtaatttatgggaaagatggtgtcacaccaataaaggatttgacagcccactttaggggggatagatgcaaaacccttttagagaaacccaaactcttcttcattcaggcttgccgagggaccgagcttgatgatggcatccaggccgactcggggcccatcaatgacacagatgctaatcctcgatacaagatcccagtggaagctgacttcctcttcgcctattccacggttccaggctattactcgtggaggagcccaggaagaggctcctggtttgtgcaagccctctgctccatcctggaggagcacggaaaagacctggaaatcatgcagatcctcaccagggtgaatgacagagttgccaggcactttgagtctcagtctgatgacccacacttccatgagaagaagcagatcccctgtgtggtctccatgctcaccaaggaactctacttcagtcaatagccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattgattaaaaatgtggttgcttaattcctaa

SEQ ID NO: 47 - DNA, 1337 bp, Artificial sequence
  Synthetic
ccatatcaggggtacattctagctgagaagcaatgggtcactcattaatgaatcacatttttttatgctcttgaaatattcagaaattctccaggattttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaaaacaaatgttcatatttattg

SEQ ID NO: 48 - DNA, 2769 bp, Artificial sequence
  Synthetic
gtgctctgagtttttggtttctgtttcaccttgtgtctgagctggtctgaaggctggttgttcagactgagcttcctgcctgcctgtaccccgccaacagcttcagaagaaggagcagcccctgggtgcgtccactttctgggcacgtgaggttgggccttggccgcctgagcccttgagttggtcacttgaaccttgggaatattgagatggacttcagcagaaatctttatgatattggggaacaactggacagtgaagatctggcctccctcaagttcctgagcctggactacattccgcaaaggaagcaagaacccatcaaggatgccttgatgttattccagagactccaggaaaagagaatgttggaggaaagcaatctgtccttcctgaaggagctgctcttccgaattaatagactggatttgctgattacctacctaaacactagaaaggaggagatggaaagggaacttcagacaccaggcagggctcaaatttctgcctacagggtcatgctctatcagatttcagaagaagtgagcagatcagaattgaggtcttttaagtttcttttgcaagaggaaatctccaaatgcaaactggatgatgacatgaacctgctggatattttcatagagatggagaagagggtcatcctgggagaaggaaagttggacatcctgaaaagagtctgtgcccaaatcaacaagagcctgctgaagataatcaacgactatgaagaattcagcaaagagagaagcagcagccttgaaggaagtcctgatgaattttcaaatggggaggagttgtgtggggtaatgacaatctcggactctccaagagaacaggatagtgaatcacagactttggacaaagtttaccaaatgaaaagcaaacctcggggatactgtctgatcatcaacaatcacaattttgcaaaagcacgggagaaagtgcccaaacttcacagcattagggacaggaatggaacacacttggatgcaggggctttgaccacgacctttgaagagcttcattttgagatcaagccccacgatgactgcacagtagagcaaatctatgagattttgaaaatctaccaactcatggaccacagtaacatggactgcttcatctgctgtatcctctcccatggagacaagggcatcatctatggcactgatggacaggaggcccccatctatgagctgacatctcagttcactggtttgaagtgcccttcccttgctggaaaacccaaagtgttttttattcaggcttgtcagggggataactaccagaaaggtatacctgttgagactgattcagaggagcaaccctatttagaaatggatttatcatcacctcaaacgagatatatcccggatgaggctgactttctgctggggatggccactgtgaataactgtgtttcctaccgaaaccctgcagagggaacctggtacatccagtcactttgccagagcctgagagagcgatgtcctcgaggcgatgatattctcaccatcctgactgaagtgaactatgaagtaagcaacaaggatgacaagaaaaacatggggaaacagatgcctcagcctactttcacactaagaaaaaaacttgtcttcccttctgattgatggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggcaataaataccagacacgtacaaaatccagctatgaatatagagggcttatgattcagattgttatctatcaactataagcccactgttaatattctattaactttaattctctttcaaagctaaattccacactaccacattaaaaaaattagaaagtagccacgtatggtggctcatgtctataatcccagcactttgggaggttgaggtgggaggattgcttgaacccaagaggtcaaggctgcagtgagccatgttcacaccgctgcactcaagcttgggtgacagaacaagaccccgtctcaaaaaaaattttttttttaataaaacaaaatttgtttgaaatcttttaaaaattcaaatgatttttacaagttttaaataagctctccccaaacttgctttatgccttcttattgcttttatgatatatatatgcttggctaactatatttgctttttgctaacaatgctctggggtctttttatgcatttgcatttgctctttcatctctgcttggattattttaaatcattaggaattaagttatctttaaaatttaagtatcttttttcaaaaacattttttaatagaataaaatataatttgatcttattaaa

SEQ ID NO: 49 - DNA, 498 bp, Artificial sequence
  Synthetic
tggtgctattttgtttgttttgttttgttttgtttttttgagacagaatctcgctctgtcgcccaggctggagtgcagtggcgtgatctcggctcaccgcaagctccgcctcccgggttcaggccattctcctgcctcagcctcccgagtagctgggactacaggggcccgccaccacacctggctaattttttaaaaatatttttagtagagacagggtttcactgtgttagccagggtggtcttgatctcctgacctcgtgatccacccacctcggcctcccaaagtgctgggattacaggcgtgagccaccgcgcctggccgatggtactatttagatataacactatgtttatttactaattttctagattttctactttattaattgttttgcacttttttataagagctaaagttaaataggatattaacaacaataacactgtctcctttctcttatgcttaaggctttgggaatgtttttagctggtggc

SEQ ID NO: 50 - DNA, 2808 bp, Artificial sequence
  Synthetic
agttggctactcgccatggacgaagcggatcggcggctcctgcggcggtgccggctgcggctggtggaagagctgcaggtggaccagctctgggacgccctgctgagccgcgagctgttcaggccccatatgatcgaggacatccagcgggcaggctctggatctcggcgggatcaggccaggcagctgatcatagatctggagactcgagggagtcaggctcttcctttgttcatctcctgcttagaggacacaggccaggacatgctggcttcgtttctgcgaactaacaggcaagcagcaaagttgtcgaagccaaccctagaaaaccttaccccagtggtgctcagaccagagattcgcaaaccagaggttctcagaccggaaacacccagaccagtggacattggttctggaggatttggtgatgtcggtgctcttgagagtttgaggggaaatgcagatttggcttacatcctgagcatggagccctgtggccactgcctcattatcaacaatgtgaacttctgccgtgagtccgggctccgcacccgcactggctccaacatcgactgtgagaagttgcggcgtcgcttctcctcgctgcatttcatggtggaggtgaagggcgacctgactgccaagaaaatggtgctggctttgctggagctggcgcagcaggaccacggtgctctggactgctgcgtggtggtcattctctctcacggctgtcaggccagccacctgcagttcccaggggctgtctacggcacagatggatgccctgtgtcggtcgagaagattgtgaacatcttcaatgggaccagctgccccagcctgggagggaagcccaagctctttttcatccaggcctgtggtggggagcagaaagaccatgggtttgaggtggcctccacttcccctgaagacgagtcccctggcagtaaccccgagccagatgccaccccgttccaggaaggtttgaggaccttcgaccagctggacgccatatctagtttgcccacacccagtgacatctttgtgtcctactctactttcccaggttttgtttcctggagggaccccaagagtggctcctggtacgttgagaccctggacgacatctttgagcagtgggctcactctgaagacctgcagtccctcctgcttagggtcgctaatgctgtttcggtgaaagggatttataaacagatgcctggttgctttaatttcctccggaaaaaacttttctttaaaacatcataaggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaaaataaatctgaggcaaatatggactctcttttgcctatttcttccctcattttgctccaactctttcttcttccttacaaaagagacttttgcttttttcgaaacatttccccatgtttttctggggtctcgctatgttgcccaggctggtctcaaactcctgggctcaagtgaccctcccaagtagctcttactacaggcgtgcaccattgcacccagccccatttattcatgtcttatttcacttgatccttatcccatcccaggaaggcaacaagggtgagaaccctgtgctcagggaggttaggtctcttgtccaagggaaaacgattatccagagaagagacctggccagaacctgggtcccctgagtcctagccatgcttcccatgtgccttacttgctgaagcacccccggactgcagtgtgaacgtgctgtgcaatagtgacacgctgggcttccccacaaggctccaccctgaggtcttttaagctgtccttatgccagcctatttcttgttttttgggcctttttttttggagatagggtctcactctgtcgcccaggctggagtgcaatgacgcaatcttggcttattgcagtctcgacctcctgggctcaagagatccttccacctcagccacctgagtagcttggactacaggtgtgcaccacctctcccagttaatttttgtatttttagtagagacagagttatgccatgttactcaggctggtcttgaactcctggactcaagcgatcagcctgccttagcctcccaaagtgcaggggttacaggcttgagccattgcgcctgacctatttctggttcttagggccctggatgttaggatggatttctgaattaataataataataaaaccctcatcaaga

SEQ ID NO: 51 - DNA, 645 bp, Artificial sequence
  Synthetic
ggccagggcccctcaccctgccttatcttgcaccccaaagctttcctgccccaggcctgaaagaggctgaggcctggactttcctgcaactcaaggactttgcagccggcacagggtctgctctttctctgccagtgacagacaggctcttagcagcttccagattgacgacaagtgctgaacagtggaggaagagggacagatgaatgccgtggattgcacgtggcctcttgagcagtggctggtccagggctagtgacttgtgtcccatgatccctgtgttgtctctagagcagggattaacctctgcactactgacatgtggggccaggtcaccctttgctgtgaggctgtcctgtacattgtgggatgttcagcactgtcccttgcctcaatgccagtaacgcgtcttcctgagtggtgccaaacaaaaaggttctcaggtgttgccaaatatgtcctggggtataaaactttcctcgcctgacaaccactggtctgtagggatttttggctacacacaaaccagtatcgctcatagatcagcaaaccggggcctactagagtctgaacagctgtaatctatgaattctaagtgaaattttaaaaattgttaatttttcctatattgcattaattttaaaa

SEQ ID NO: 52 - DNA, 2064 bp, Artificial sequence
  Synthetic
agttttcacttaaacaaccagcaagtcttgaagtctcttcccaagcaaatgggagcttctttggaccttggagcacacagaggattctactttctttaaaactttgttttcaggcaatttccctgagaaccgtttacttccagaagattggtggagcttgatctgaaggctggccatgaaatctcaaggtcaacattggtattccagttcagataaaaactgtaaagtgagctttcgtgagaagcttctgattattgattcaaacctgggggtccaagatgtggagaacctcaagtttctctgcataggattggtccccaacaagaagctggagaagtccagctcagcctcagatgtttttgaacatctcttggcagaggatctgctgagtgaggaagaccctttcttcctggcagaactcctctatatcatacggcagaagaagctgctgcagcacctcaactgtaccaaagaggaagtggagcgactgctgcccacccgacaaagggtttctctgtttagaaacctgctctacgaactgtcagaaggcattgactcagagaacttaaaggacatgatcttccttctgaaagactcgcttcccaaaactgaaatgacctccctaagtttcctggcatttctagagaaacaaggtaaaatagatgaagataatctgacatgcctggaggacctctgcaaaacagttgtacctaaacttttgagaaacatagagaaatacaaaagagagaaagctatccagatagtgacacctcctgtagacaaggaagccgagtcgtatcaaggagaggaagaactagtttcccaaacagatgttaagacattcttggaagccttaccgcaggagtcctggcaaaataagcatgcaggtagtaatggtaacagagccacaaatggtgcaccaagcctggtctccagggggatgcaaggagcatctgctaacactctaaactctgaaaccagcacaaagagggcagctgtgtacaggatgaatcggaaccacagaggcctctgtgtcattgtcaacaaccacagctttacctccctgaaggacagacaaggaacccataaagatgctgagatcctgagtcatgtgttccagtggcttgggttcacagtgcatatacacaataatgtgacgaaagtggaaatggagatggtcctgcagaagcagaagtgcaatccagcccatgccgacggggactgcttcgtgttctgtattctgacccatgggagatttggagctgtctactcttcggatgaggccctcattcccattcgggagatcatgtctcacttcacagccctgcagtgccctagactggctgaaaaacctaaactctttttcatccaggcctgccaaggtgaagagatacagccttccgtatccatcgaagcagatgctctgaaccctgagcaggcacccacttccctgcaggacagtattcctgccgaggctgacttcctacttggtctggccactgtcccaggctatgtatcctttcggcatgtggaggaaggcagctggtatattcagtctctgtgtaatcatctgaagaaattggtcccaaggatgctgaaatttctggaaaagacaatggaaatcaggggcaggaagagaacagtgtggggtgctaaacagatctcagcaacctccctgcccacggccatctctgcgcagacacctcgaccccccatgcgcaggtggagcagcgtttcctagttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 53 - DNA, 323 bp, Artificial sequence
  Synthetic
ttctttccagaggcttccttctgcctgccttccagccacatcgcctgagattgacaacgccctacagcaagacggaaacctccctttacagcaccaccttgcgattctgcagccacaaagttgagacttctgaacgtggcactcttctgttcccttactgtttcacgtgtacctgtgtcatctttcttgtttcatcgtaaacatacttctaaaattcccattttctttatttagaaatagaactacaagcggatggttaaacaatttaaacaaatggtccatggggaaaagtgaatttcacactgtcccccaaactttcagtg

SEQ ID NO: 54 - DNA, 2690 bp, Artificial sequence
  Synthetic
gtcatagccaagcacgctgcttcttggattgacctggcaggatggcgccaccaccagctagagtacatctaggtgcgttcctggcagtgactccgaatcccgggagcgcagcgagtgggacagaggcagccgcggccacacccagcaaagtgtggggctcttccgcggggaggattgaaccacgaggcgggggccgaggagcgctccctacctccatgggacagcacggacccagtgcccgggcccgggcagggcgcgccccaggacccaggccggcgcgggaagccagccctcggctccgggtccacaagaccttcaagtttgtcgtcgtcggggtcctgctgcaggtcgtacctagctcagctgcaaccatcaaacttcatgatcaatcaattggcacacagcaatgggaacatagccctttgggagagttgtgtccaccaggatctcatagatcagaacatcctggagcctgtaaccggtgcacagagggtgtgggttacaccaatgcttccaacaatttgtttgcttgcctcccatgtacagcttgtaaatcagatgaagaagagagaagtccctgcaccacgaccaggaacacagcatgtcagtgcaaaccaggaactttccggaatgacaattctgctgagatgtgccggaagtgcagcagagggtgccccagagggatggtcaaggtcaaggattgtacgccctggagtgacatcgagtgtgtccacaaagaatcaggcaatggacataatatatgggtgattttggttgtgactttggttgttccgttgctgttggtggctgtgctgattgtctgttgttgcatcggctcaggttgtggaggggaccccaagtgcatggacagggtgtgtttctggcgcttgggtctcctacgagggcctggggctgaggacaatgctcacaacgagattctgagcaacgcagactcgctgtccactttcgtctctgagcagcaaatggaaagccaggagccggcagatttgacaggtgtcactgtacagtccccaggggaggcacagtgtctgctgggaccggcagaagctgaagggtctcagaggaggaggctgctggttccagcaaatggtgctgaccccactgagactctgatgctgttctttgacaagtttgcaaacatcgtgccctttgactcctgggaccagctcatgaggcagctggacctcacgaaaaatgagatcgatgtggtcagagctggtacagcaggcccaggggatgccttgtatgcaatgctgatgaaatgggtcaacaaaactggacggaacgcctcgatccacaccctgctggatgccttggagaggatggaagagagacatgcaagagagaagattcaggacctcttggtggactctggaaagttcatctacttagaagatggcacaggctctgccgtgtccttggagtgaaagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataaaataaaataaacttgaaagaattattgcccgactgaggctcacatgccaaaggaaaatctggttctcccctgagctggcctccgtgtgtttccttatcatggtggtcaattggaggtgttaatttgaatggattaaggaacacctagaacactggtaaggcattatttctgggacattatttctgggcatgtcttcgagggtgtttccagaggggattggcatgcgatcgggtggactgagtggaaaagacctacccttaatttgggggggcaccgtccgacagactggggagcaagatagaagaaaacaaaaaaaaaaggaaaagcaaatccatctgatctcctggagctgggacactcttctgcctgtggacatcagagtctaggatttctagcccttggactccagggcatacaccagtggcctcccgaaggatctaaggattttggccttgaactaagaattacaccatcggcttccctgggtcttaggtttttgggctggattaagtcctgcttccagcatttcagggtctctgctgtgcagatggcctgttgtggaacttctcaacctccattatcagatgcattaattcctccaataagtcccatttcatatatagtcatttaccccacaacatttcagtcaagggaacagcatataagatggtggccgtccagtaagctaaggttaatttattaattatttaatttatttaccttgagttcaagtcacaattaaagtacatatacctttggaaatttggacttttgtatataaaagtacttttttttggcgggggcagtgggcagctctcatcctaaacaaatgtgttatttggtacctatgcaaagatttggttaaaa

SEQ ID NO: 55 - DNA, 375 bp, Artificial sequence
  Synthetic
aagactctttttaccagaggtttcctcttaggtgttaggagttaatacatattaggttttttttttttttaacatgtatacaaagtaaattcttagccaggtgtagtggctcatgcctgtaatcccagcactttgggaggctgaggcgggtggatcacttgaggtcagaagttcaagaccagcctgaccaacatcgtgaaatgccgtctttacaaaaaaatacaaaaattaactggatgtgatggtgtgtgcatatattctcggctactcgggaggctgaggcaggagaatcacttgaacccacgaggcagtgagctgagattgcaccactgcactccagcctgggacacagagcaagactctgtctcaagataa

SEQ ID NO: 56 - DNA, 3998 bp, Artificial sequence
  Synthetic
agcctggacacataaatcagcacgcggccggagaaccccgcaatctctgcgcccacaaaatacaccgacgatgcccgatctactttaagggctgaaacccacgggcctgagagactataagagcgttccctaccgccatggaacaacggggacagaacgccccggccgcttcgggggcccggaaaaggcacggcccaggacccagggaggcgcggggagccaggcctgggccccgggtccccaagacccttgtgctcgttgtcgccgcggtcctgctgttggtctcagctgagtctgctctgatcacccaacaagacctagctccccagcagagagcggccccacaacaaaagaggtccagcccctcagagggattgtgtccacctggacaccatatctcagaagacggtagagattgcatctcctgcaaatatggacaggactatagcactcactggaatgacctccttttctgcttgcgctgcaccaggtgtgattcaggtgaagtggagctaagtccctgcaccacgaccagaaacacagtgtgtcagtgcgaagaaggcaccttccgggaagaagattctcctgagatgtgccggaagtgccgcacagggtgtcccagagggatggtcaaggtcggtgattgtacaccctggagtgacatcgaatgtgtccacaaagaatcaggtacaaagcacagtggggaagtcccagctgtggaggagacggtgacctccagcccagggactcctgcctctccctgttctctctcaggcatcatcataggagtcacagttgcagccgtagtcttgattgtggctgtgtttgtttgcaagtctttactgtggaagaaagtccttccttacctgaaaggcatctgctcaggtggtggtggggaccctgagcgtgtggacagaagctcacaacgacctggggctgaggacaatgtcctcaatgagatcgtgagtatcttgcagcccacccaggtccctgagcaggaaatggaagtccaggagccagcagagccaacaggtgtcaacatgttgtcccccggggagtcagagcatctgctggaaccggcagaagctgaaaggtctcagaggaggaggctgctggttccagcaaatgaaggtgatcccactgagactctgagacagtgcttcgatgactttgcagacttggtgccctttgactcctgggagccgctcatgaggaagttgggcctcatggacaatgagataaaggtggctaaagctgaggcagcgggccacagggacaccttgtacacgatgctgataaagtgggtcaacaaaaccgggcgagatgcctctgtccacaccctgctggatgccttggagacgctgggagagagacttgccaagcagaagattgaggaccacttgttgagctctggaaagttcatgtatctagaaggtaatgcagactctgccatgtcctaagtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaaattaaatatgaaaccttatataaaaa

SEQ ID NO: 57 - DNA, 2512 bp, Artificial sequence
  Synthetic
gtgtgattctcttcaggaagtcagaccttccctggtttaccttttttctggaaaaagcccaactggactccagtcagtaggaaagtgccacaattgtcacatgaccggtactggaagaaactctcccatccaacatcacccagtggatggaacatcctgtaacttttcactgcacttggcattatttttataagctgaatgtgataataaggacactatggaaatgtctggatcattccgtttgtgcgtactttgagatttggtttgggatgtcattgttttcacagcacttttttatcctaatgtaaatgctttatttatttatttgggctacattgtaagatccatctacacagtcgttgtccgacttcacttgatactatatgatatgaaccttttttgggtggggggtgcggggcagttcactctgtctcccaggctggagtgcaatggtgcaatcttggctcactatagccttgacctctcaggctcaagcgattctcccacctcagccatccaaatagctgggaccacaggtgtgcaccaccacgcccggctaattttttgtattttgtctagatataggggctctctatgttgctcagggtggtctcgaattcctggactcaagcagtctgcccacctcagactcccaaagcggtggaattagaggcgtgagcccccatgcttggccttacctttctacttttataattctgtatgttattattttatgaacatgaagaaactttagtaaatgtacttgtttacatagttatgtgaatagattagataaacataaaaggaggagacatacaatgggggaagaagaagaagtcccctgtaagatgtcactgtctgggttccagccctccctcagatgtactttggcttcaatgattggcaacttctacaggggccagtcttttgaactggacaaccttacaagtatatgagtattatttataggtagttgtttacatatgagtcgggaccaaagagaactggatccacgtgaagtcctgtgtgtggctggtccctacctgggcagtctcatttgcacccatagcccccatctatggacaggctgggacagaggcagatgggttagatcacacataacaatagggtctatgtcatatcccaagtgaacttgagccctgtttgggctcaggagatagaagacaaaatctgtctcccacgtctgccatggcatcaagggggaagagtagatggtgcttgagaatggtgtgaaatggttgccatctcaggagtagatggcccggctcacttctggttatctgtcaccctgagcccatgagctgccttttagggtacagattgcctacttgaggaccttggccgctctgtaagcatctgactcatctcagaaatgtcaattcttaaacactgtggcaacaggacctagaatggctgacgcattaaggttttcttcttgtgtcctgttctattattgttttaagacctcagtaaccatttcagcctctttccagcaaacccttctccatagtatttcagtcatggaaggatcatttatgcaggtagtcattccaggagtttttggtcttttctgtctcaaggcattgtgtgttttgttccgggactggtttgggtgggacaaagttagaattgcctgaagatcacacattcagactgttgtgtctgtggagttttaggagtggggggtgacctttctggtctttgcacttccatcctctcccacttccatctggcatcccacgcgttgtcccctgcacttctggaaggcacagggtgctgctgcctcctggtctttgcctttgctgggccttctgtgcaggacgctcagcctcagggctcagaaggtgccagtccggtcccaggtcccttgtcccttccacagaggccttcctagaagatgcatctagagtgtcagccttatcagtgtttaagatttttcttttatttttaatttttttgagacagaatctcactctctcgcccaggctggagtgcaacggtacgatcttggctcagtgcaacctccgcctcctgggttcaagcgattctcgtgcctcagcctccggagtagctgggattgcaggcacccgccaccacgcctggctaatttttgtatttttagtagagacggggtttcaccatgttggtcaggctggtctcgaactcctgacctcaggtgatccaccttggcctccgaaagtgctgggattacaggcgtgagccaccagccaggccaagctattcttttaaagtaagcttcctgacgacatgaaataattgggggttttgttgtttagttacattaggctttgctatatccccaggccaaatagcatgtgacacaggacagccatagtatagtgtgtcactcgtggttggtgtcctttcatgcttctgccctgtcaaaggtccctatttgaaatgtgttataatacaaacaaggaagcacattgtgtacaaaatacttatgtatttatgaatccatgaccaa

SEQ ID NO: 58 - DNA, 7201 bp, Artificial sequence
  Synthetic
agaggcggagaagaagaggtagcgagtggacgtgactgctctatcccgggcaaaagggatagaaccagaggtggggagtctgggcagtcggcgacccgcgaagacttgaggtgccgcagcggcatccggagtagcgccgggctccctccggggtgcagccgccgtcgggggaagggcgccacaggccgggaagacctcctccctttgtgtccagtagtggggtccaccggagggcggcccgtgggccgggcctcaccgcggcgctccgggactgtggggtcaggctgcgttgggtggacgcccacctcgccaaccttcggaggtccctgggggtcttcgtgcgccccggggctgcagagatccaggggaggcgcctgtgaggcccggacctgccccggggcgaagggtatgtggcgagacagagccctgcacccctaattcccggtggaaaactcctgttgccgtttccctccaccggcctggagtctcccagtcttgtcccggcagtgccgccctccccactaagacctaggcgcaaaggcttggctcatggttgacagctcagagagagaaagatctgagggaagatggatgcaaaagctcgaaattgtttgcttcaacatagagaagctctggaaaaggacatcaagacatcctacatcatggatcacatgattagtgatggatttttaacaatatcagaagaggaaaaagtaagaaatgagcccactcaacagcaaagagcagctatgctgattaaaatgatacttaaaaaagataatgattcctacgtatcattctacaatgctctactacatgaaggatataaagatcttgctgcccttctccatgatggcattcctgttgtctcttcttccagtggtaaagattcagttagtggaataacttcgtatgtaaggacagtcctgtgtgaaggtggagtaccacagaggccagttgtttttgtcacaaggaagaagctggtgaatgcaattcagcagaagctctccaaattgaaaggtgaaccaggatgggtcaccatacatggaatggcaggctgtgggaagtctgtattagctgcagaagctgttagagatcattcccttttagaaggttgtttcccagggggagtgcattgggtttcagttgggaaacaagacaaatctgggcttctgatgaaactgcagaatctttgcacacggttggatcaggatgagagtttttcccagaggcttccacttaatattgaagaggctaaagaccgtctccgcattctgatgcttcgcaaacacccaaggtctctcttgatcttggatgatgtttgggactcttgggtgttgaaagcttttgacagtcagtgtcagattcttcttacaaccagagacaagagtgttacagattcagtaatgggtcctaaatatgtagtccctgtggagagttccttaggaaaggaaaaaggacttgaaattttatccctttttgttaatatgaagaaggcagatttgccagaacaagctcatagtattataaaagaatgtaaaggctctccccttgtagtatctttaattggtgcacttttacgtgattttcccaatcgctgggagtactacctcaaacagcttcagaataagcagtttaagagaataaggaaatcttcgtcttatgattatgaggctctagatgaagccatgtctataagtgttgaaatgctcagagaagacatcaaagattattacacagatctttccatccttcagaaggacgttaaggtgcctacaaaggtgttatgtattctctgggacatggaaactgaagaagttgaagacatactgcaggagtttgtaaataagtctcttttattctgtgatcggaatggaaagtcgtttcgttattatttacatgatcttcaagtagattttcttacagagaagaattgcagccagcttcaggatctacataagaagataatcactcagtttcagagatatcaccagccgcatactctttcaccagatcaggaagactgtatgtattggtacaactttctggcctatcacatggccagtgccaagatgcacaaggaactttgtgctttaatgttttccctggattggattaaagcaaaaacagaacttgtaggccctgctcatctgattcatgaatttgtggaatacagacatatactagatgaaaaggattgtgcagtcagtgagaattttcaggagtttttatctttaaatggacaccttcttggacgacagccatttcctaatattgtacaactgggtctctgtgagccggaaacttcagaagtttatcagcaagctaagctgcaggccaagcaggaggtcgataatggaatgctttacctggaatggataaacaaaaaaaacatcacgaatctttcccgcttagttgtccgcccccacacagatgctgtttaccatgcctgcttttctgaggatggtcagagaatagcttcttgtggagctgataaaaccttacaggtgttcaaagctgaaacaggagagaaacttctagaaatcaaggctcatgaggatgaagtgctttgttgtgcattctctacagatgacagatttatagcaacctgctcagtggataaaaaagtgaagatttggaattctatgactggggaactagtacacacctatgatgagcactcagagcaagtcaattgctgccatttcaccaacagtagtcatcatcttctcttagccactgggtcaagtgactgcttcctcaaactttgggatttgaatcaaaaagaatgtcgaaataccatgtttggtcatacaaattcagtcaatcactgcagattttcaccagatgataagcttttggctagttgttcagctgatggaaccttaaagctttgggatgcgacatcagcaaatgagaggaaaagcattaatgtgaaacagttcttcctaaatttggaggaccctcaagaggatatggaagtgatagtgaagtgttgttcgtggtctgctgatggtgcaaggataatggtggcagcaaaaaataaaatctttctttttgacattcatactagtggcctattgggagaaatccacacgggccatcacagcaccatccagtactgtgacttctccccacaaaaccatttggcagtggttgctttgtcccagtactgtgtagagttgtggaatacagactcacgttcaaaggtggctgattgcagaggacatttaagttgggttcatggtgtgatgttttctcctgatggatcatcatttttgacatcttctgatgaccagacaatcaggctctgggagacaaagaaagtatgtaagaactctgctgtaatgttaaagcaagaagtagatgttgtgtttcaagaaaatgaagtgatggtccttgcagttgaccatataagacgtctgcaactcattaatggaagaacaggtcagattgattatctgactgaagctcaagttagctgctgttgcttaagtccacatcttcagtacattgcatttggagatgaaaatggagccattgagattttagaacttgtaaacaatagaatcttccagtccaggtttcagcacaagaaaactgtatggcacatccagttcacagccgatgagaagactcttatttcaagttctgatgatgctgaaattcaggtatggaattggcaattggacaaatgtatctttctacgaggccatcaggaaacagtgaaagactttagactcttgaaaaattcaagactgctttcttggtcatttgatggaacagtgaaggtatggaatattattactggaaataaagaaaaagactttgtctgtcaccagggtacagtactttcttgtgacatttctcacgatgctaccaagttttcatctacctctgctgacaagactgcaaagatctggagttttgatctccttttgccacttcatgaattgaggggccacaacggctgtgtgcgctgctctgccttctctgtggacagtaccctgctggcaacgggagatgacaatggagaaatcaggatatggaatgtctcaaacggtgagcttcttcatttgtgtgctccgctttcagaagaaggagctgctacccatggaggctgggtgactgacctttgcttttctccagatggcaaaatgcttatctctgctggaggatatattaagtggtggaacgttgtcactggggaatcctcacagaccttctacacaaatggaaccaatcttaagaaaatacacgtgtcccctgacttcaaaacatatgtgactgtggataatcttggtattttatatattttacagactttagaataaaatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaaattcacaaaattgttttgaaaaaca

SEQ ID NO: 59 - DNA, 2842 bp, Artificial sequence
  Synthetic
aatagttaagcattaatgtagttgaactttttaaatttttgaattggaaaaaaattctaatgaaaccctgatatcaactttttataaagctcttaattgttgtgcagtattgcattcattacaaaagtgtttgtggttggatgaataatattaatgtagctttttcccaaatgaacatacctttaatcttgtttttcatgatcatcattaacagtttgtccttaggatgcaaatgaaaatgtgaatacataccttgttgtactgttggtaaaattctgtcttgatgcattcaaaatggttgacataattaatgagaagaatttggaagaaattggtattttaatactgtctgtatttattactgttatgcaggctgtgcctcagggtagcagtggcctgctttttgaaccacacttaccccaagggggttttgttctcctaaatacaatcttagaggttttttgcactctttaaatttgctttaaaaatattgtgtctgtgtgcatagtctgcagcatttcctttaattgactcaataagtgagtcttggatttagcaggcccccccaccttttttttttgtttttggagacagagtcttgctttgttgccaggctggagtgcagtggcgcgatctcggctcaccacaatcgctgcctcctgggttcaagcaattctcctgcctcagcctcccgagtagctgggactacaggtgtgcgcacatgccaggctaatttttgtatttttagtagagacggggtttcaccatgttggccgggatggtctcgatctcttgacctcatgatctacccgccttggcctcccaaagtgctgagattacaggcgtgagccaccgtgcctggccaggccccttctcttttaatggagacagggtcttgcactatcacccaggctggagtgcagtggcataatcatacctcattgcagcctcagactcctgggttcaagcaatcctcctgcctcagcctcccaagtagctgagactacaggcacgagccaccacacccagctaatttttaagttttcttgtagagacagggtctcactatgttgtctaggctggtcttgaactcttggcctcaagtaatcctcctgcctcagcctcccaaagtgttgggattgcagatatgagccactggcctggccttcagcagttctttttgtgaagtaaaacttgtatgttggaaagagtagattttattggtctacccttttctcactgtagctgctggcagccctgtgccatatctggactctagttgtcagtatctgagttggacactattcctgctccctcttgtttcttacatatcagacttcttacttgaatgaaacctgatctttcctaatcctcacttttttcttttttaaaaagcagtttctccactgctaaatgttagtcattgaggtggggccaattttaatcataagccttaataagatttttctaagaaatgtgaaatagaacaattttcatctaattccatttacttttagatgaatggcattgtgaatgccattcttttaatgaatttcaagagaattctctggttttctgtgtaattccagatgagtcactgtaactctagaagattaaccttccagccaacctattttcctttcccttgtctctctcatcctcttttccttccttctttcctttctcttcttttatctccaaggttaatcaggaaaaatagcttttgacaggggaaaaaactcaataactagctatttttgacctcctgatcaggaactttagttgaagcgtaaatctaaagaaacattttctctgaaatatattattaagggcaatggagataaattaatagtagatgtggttcccagaaaatataatcaaaattcaaagattttttttgtttctgtaactggaactaaatcaaatgattactagtgttaatagtagataacttgtttttattgttggtgcatattagtataactgtggggtaggtcggggagagggtaagggaatagatcactcagatgtattttagataagctatttagcctttgatggaatcataaatacagtgaatacaatcctttgcattgttaaggaggttttttgtttttaaatggtgggtcaaggagctagtttacaggcttactgtgatttaagcaaatgtgaaaagtgaaaccttaattttatcaaaagaaatttctgtaaatggtatgtctccttagaatacccaaatcataattttatttgtacacactgttaggggctcatctcatgtaggcagagtataaagtattaccttttggaattaaaagccactgactgttataaagtataacaacacacatcaggttttaaaaagccttgaatggcccttgtcttaaaaagaaattaggagccaggtgcggtggcacgtgcctgtaatcccagctccttgggaggctaagacaggaggattccttgagccctggagtttgagtccagcctgggtgacatagcaagaccctgtcttaaaagaaaaatgggaagaaagacaaggtaacatgaagaaagaagagatacctagtatgatggagctgcaaatttcatggcagttcatgcagtcggtcaagaggaggattttgttttgtagtttgcagatgagcatttctaaagcattttcccttgctgtatttttttgtattataaattacattggacttcatatatataatttttttttacattatatgtctcttgtatgttttgaaactcttgtatttatgatatagcttatatgatttttttgccttggtatacattttaaaatatgaatttaaaaaatttttgtaaaaataaa

SEQ ID NO: 60 - DNA, 2999 bp, Artificial sequence
  Synthetic
cgcccatttgccattcactgcagtagcaaaagtagtactctgtggtgggttaatcggtttgaggcagctccttaaatgaacatttgtgtttcatttttctgttattttcccgaacatgaaaagacgataaaactgaaatggaaaagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggc

SEQ ID NO: 61 - DNA, 786 bp, Artificial sequence
  Synthetic
gattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtacataacttgggggtatgtgtgcaggattacccaagaataacttaagtagaagaaacaagaaagggaatcttgtatatttttgttgatagttcatgtttttcccccagccacaattttaccggaagggtgacaggaaggc

SEQ ID NO: 62 - DNA, 3126 bp, Artificial sequence
  Synthetic
agttatttcacagatgccactggggtaggtaaactgacccaactctgcagcactcagaagacgaagcaaagccttctacttgagcagtttttccatcactgatatgtgcaggaaatgaagacattgcctgccatgcttggaactgggaaattattttgggtcttcttcttaatcccatatctggacatctggaacatccatgggaaagaatcatgtgatgtacagctttatataaagagacaatctgaacactccatcttagcaggagatccctttgaactagaatgccctgtgaaatactgtgctaacaggcctcatgtgacttggtgcaagctcaatggaacaacatgtgtaaaacttgaagatagacaaacaagttggaaggaagagaagaacatttcatttttcattctacattttgaaccagtgcttcctaatgacaatgggtcataccgctgttctgcaaattttcagtctaatctcattgaaagccactcaacaactctttatgtgacagatgtaaaaagtgcctcagaacgaccctccaaggacgaaatggcaagcagaccctggctcctgtatcgtttacttcctttggggggattgcctctactcatcactacctgtttctgcctgttctgctgcctgagaaggcaccaaggaaagcaaaatgaactctctgacacagcaggaagggaaattaacctggttgatgctcaccttaagagtgagcaaacagaagcaagcaccaggcaaaattcccaagtactgctatcagaaactggaatttatgataatgaccctgacctttgtttcaggatgcaggaagggtctgaagtttattctaatccatgcctggaagaaaacaaaccaggcattgtttatgcttccctgaaccattctgtcattggaccgaactcaagactggcaagaaatgtaaaagaagcaccaacagaatatgcatccatatgtgtgaggagttaagtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatcaa

SEQ ID NO: 63 - DNA, 2142 bp, Artificial sequence
  Synthetic
gtctgtttctgactccaacagggaccattgaatgatcagcatgttgacatcattgtctgggctcaacaggatgtcaaataatatttctcaatttgagaatttttactttagaaatgttcatgttagtgcttgggtcttaagggtccataggataaatgattaaaatttctctcagaaacttatttgggagctttttatattatagccttgaataacaaaatctctccaaaactggttgacatcatgagtagcagaatagtagaacgtttaaacttagctacattttacccaatatacaaactcgatcttgcctttgaagctattggaaagacttgtagggaaaagaggtttgtgttacctgcatcagttcactacacactcttgaaaacaaaatgtcccaatttgactaaccaaccataaatacagtaatgattgtatatttcaagtcagtcttccaaaataagaaatttttgctgtgtcagtctaagaatggtgtttcttaaatgcaaaggagaaatcattttaggcttgatgtaagaaaatgaaaataataaatggtgcaataaaaatatagaatataccaattggatatagggtagatgttccacatacctggcaaacaaatgcttatatctactctgttagattgataagcaaatataggtattaatggagcagtcaacgtatagcacatttatgaggaaagtagagactcactgggtcacatagactaatggataggaatgtgacataatgctgctgaattaatatacttatgggcatctgaatagtttaaaagttagtcagaataggtatcactgggcaagtgaagatagcttaaactgcttcatgcttgacttgatagcaagttaaagtgcaattaatggaatggaggaaaacccagaatatttaattggtctgtaggggtcaatttgctttcattcaccacatctgcatcttgctgttcttcttactaaggaatcagggcaaatcatctgtagtgacatattttagtttgctaatcatttattttaaaatactgaggttgcagccacttaagagtatagcaaaagatggattcagatttttggactttccaaagtacttgagttaaactatttcaaaaatagcctataattttattcaacagtttgaggctattcgaattctcaggtgctgctactgaataatgtaatagtcttcatacaaagtggatagcaaaggttaaaatccatttcaacaaatatgtgagctgagctgctgcacaaaggaatgtgatgtgtgtgtgtgtgtgtgtgtgtgtgtgtgttaggtggggtgggtgacaacagaaatggtgcacgagaaactgatcaaattgacattatattttcagtttgcttatgaagctcaaaatactagagtaaatgggtcattaaagaaaataatatgtgaaattatggagtttagaatacaagtggggtatatatacaaaaagacaaaactgaggttttgtggtggagagattttcttaagtaacactggcattaagttttagctccttagatttgggggtgcaaatattcttttgagtcactgttattttgccaattacacctagaatttcaagcaaccaattcgagataggctgttttagccaggctgcatttgtggacaacttatgtaagaaagacatgttagaatagctgcttgtggtattcttaaaaatagaaacaggaaatatggggaggatacatttagctgtcctcttatcagatgaacacacgaaattgaacagttccttcatgattctctcaaacttaaaagcaaaatatttctgtcttatttaaaatatccttagtatgtcttatagtaaagataatgctgataatgatttcatctctaagatgtattaatatatttgtactgtttgccaaaatcacaaatcatttatgtttttattccttttcaaaatggtgtcagagacatacatgcattttcccaaatgactctacttcactattatttacatggcttatttcattagtttatagagggtttgagaaaaagaatatgtagataatttaatggtttttcacaaattttaagcttgtgattgtgctcaatgagaaggtaaagttattaaaacttatttgaaatcaa

SEQ ID NO: 64 - DNA, 1976 bp, Artificial sequence
  Synthetic
agagaccagcagaacggcatcccagccacgacggccactttgctctgtctgctctccgccacggccctgctctgttccctgggacacccccgcccccacctcctcaggctgcctgatctgcccagctttccagctttcctctggattccggcctctggtcatccctccccaccctctctccaaggccctctcctggtctcccttcttctagaaccccttcctccacctccctctctgcagaacttctcctttaccccccaccccccaccactgccccctttccttttctgacctccttttggagggctcagcgctgcccagaccataggagagatgtgggaggctcagttcctgggcttgctgtttctgcagccgctttgggtggctccagtgaagcctctccagccaggggctgaggtcccggtggtgtgggcccaggagggggctcctgcccagctcccctgcagccccacaatccccctccaggatctcagccttctgcgaagagcaggggtcacttggcagcatcagccagacagtggcccgcccgctgccgcccccggccatcccctggcccccggccctcacccggcggcgccctcctcctgggggcccaggccccgccgctacacggtgctgagcgtgggtcccggaggcctgcgcagcgggaggctgcccctgcagccccgcgtccagctggatgagcgcggccggcagcgcggggacttctcgctatggctgcgcccagcccggcgcgcggacgccggcgagtaccgcgccgcggtgcacctcagggaccgcgccctctcctgccgcctccgtctgcgcctgggccaggcctcgatgactgccagccccccaggatctctcagagcctccgactgggtcattttgaactgctccttcagccgccctgaccgcccagcctctgtgcattggttccggaaccggggccagggccgagtccctgtccgggagtccccccatcaccacttagcggaaagcttcctcttcctgccccaagtcagccccatggactctgggccctggggctgcatcctcacctacagagatggcttcaacgtctccatcatgtataacctcactgttctgggtctggagcccccaactcccttgacagtgtacgctggagcaggttccagggtggggctgccctgccgcctgcctgctggtgtggggacccggtctttcctcactgccaagtggactcctcctgggggaggccctgacctcctggtgactggagacaatggcgactttacccttcgactagaggatgtgagccaggcccaggctgggacctacacctgccatatccatctgcaggaacagcagctcaatgccactgtcacattggcaatcatcacagtgactcccaaatcctttgggtcacctggatccctggggaagctgctttgtgaggtgactccagtatctggacaagaacgctttgtgtggagctctctggacaccccatcccagaggagtttctcaggaccttggctggaggcacaggaggcccagctcctttcccagccttggcaatgccagctgtaccagggggagaggcttcttggagcagcagtgtacttcacagagctgtctagcccaggtgcccaacgctctgggagagccccaggtgccctcccagcaggccacctcctgctgtttctcatccttggtgtcctttctctgctccttttggtgactggagcctttggctttcacctttggagaagacagtggcgaccaagacgattttctgccttagagcaagggattcaccctccgcaggctcagagcaagatagaggagctggagcaagaaccggagccggagccggagccggaaccggagcccgagcccgagcccgagccggagcagctctgacctggagctgaggcagccagcagatctcagcagcccagtccaaataaactccctgtcagcagcaa

SEQ ID NO: 65 - DNA, 2139 bp, Artificial sequence
  Synthetic
acatctgcttcctgtaggccctctgggcagaagcatgcgctggtgtctcctcctgatctgggcccaggggctgaggcaggctcccctcgcctcaggaatgatgacaggcacaatagaaacaacggggaacatttctgcagagaaaggtggctctatcatcttacaatgtcacctctcctccaccacggcacaagtgacccaggtcaactgggagcagcaggaccagcttctggccatttgtaatgctgacttggggtggcacatctccccatccttcaaggatcgagtggccccaggtcccggcctgggccttaccctccagtcgctgaccgtgaacgatacaggggagtacttctgcatctatcacacctaccctgatggggcgtacactgggagaatcttcctggaggtcctagaaagctcagtggctgagcacggtgccaggttccagattccattgcttggagccatggccgcgacgctggtggtcatctgcacagcagtcatcgtggtggtcgcgttgactagaaagaagaaagccctcagaatccattctgtggaaggtgacctcaggagaaaatcagctggacaggaggaatggagccccagtgctccctcacccccaggaagctgtgtccaggcagaagctgcacctgctgggctctgtggagagcagcggggagaggactgtgccgagctgcatgactacttcaatgtcctgagttacagaagcctgggtaactgcagcttcttcacagagactggttagcaaccagaggcatcttctggaagatacacttttgtctttgctattatagatgaatatataagcagctgcactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaacaccttcaaactaacttcttcgaacccttttattcactccctgacgactttgtgctggggttggggtaactgaactgcttatttctgtttaattgcattcaggctggatcttagaagacttttatccttccaccatctctctcagaggaatgagcggggaggttggatttactggtgactgattttctttcatgggccaaggaactgaaagagaatgtgaagcaaggttgtgtcttgcgcatggttaaaaataaagcattgtcctgcttcctaag

SEQ ID NO: 66 - DNA, 1095 bp, Artificial sequence
  Synthetic
caaccagaggcatcttctggaagatacacttttgtctttgctattatagatgaatatataagcagctgcactctccatcagtgctgcgtgtgtgtgtgtgtgtgtatgtgtgtgtgtgttcagttgagtgaataaatgtcatcctcttctccatcttcatttccttggccttttcgttctattccattttgcattatggcaggcctagggtgagtaacgtggatcttgatcataaatgcaaaattaaaaaatatcttgacctggttttaaatctggcagtttgagcagatcctatgtctctgagagacacattcctcataatggccagcattttgggctacaaggttttgtggttgatgatgaggatggcatgactgcagagccatcctcatctcattttttcacgtcattttcagtaactttcactcattcaaaggcaggttataagtaagtcctggtagcagcctctatggggagatttgagagtgactaaatcttggtatctgccctcaagaacttacagttaaatggggagacaatgttgtcatgaaaaggtattatagtaaggagagaaggagacatacacaggccttcaggaagagacgacagtttggggtgaggtagttggcataggcttatctgtgatgaagtggcctgggagcaccaaggggatgttgaggctagtctgggaggagcaggagttttgtctagggaacttgtaggaaattcttggagctgaaagtcccacaaagaaggccctggcaccaagggagtcagcaaacttcagattttattctctgggcaggcatttcaagtttccttttgctgtgacatactcatccattagacagcctgatacaggcctgtagcctcttccggccgtgtgtgctggggaagccccaggaaacgcacatgcccacacagggagccaagtcgtagcatttgggccttgatctaccttttctgcatcaatacactcttgagcctttgaaaaaagaacgtttcccactaaaaagaaaatgtggatttttaaaatagggactcttcctaggggaaaaaggggggctgggagtgatagagggtttaaaaaataaa

SEQ ID NO: 67 - DNA, 1675 bp, Artificial sequence
  Synthetic
attcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaaggactggtctttctatctcttgtactacactgaattcacccccactgaaaaagatgagtatgcctgccgtgtgaaccatgtgactttgtcacagcccaagatagttaagtgggatcgagacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataacagatttaaaattttcaaggcatagttttatacctga

SEQ ID NO: 68 - DNA, 1248 bp, Artificial sequence
  Synthetic
gcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccacaagttaaataaatcataaaacttgatgtgttatctcttatatctcactcccactattacccctttattttcaaacagggaaacagtcttcaagttccacttggtaaaaaatgtgaaccccttgtatatagagtttggctcacagtgtaaagggcctcagtgattcacattttccagattaggaatctgatgctcaaagaagttaaatggcatagttggggtgacacagctgtctagtgggaggccagccttctatattttagccagcgttctttcctgcgggccaggtcatgaggagtatgcagactctaagagggagcaaaagtatctgaaggatttaatattttagcaaggaatagatatacaatcatcccttggtctccctgggggattggtttcaggaccccttcttggacaccaaatctatggatatttaagtcccttctataaaatggtatagtatttgcatataacctatccacatcctcctgtatactttaaatcatttctagattacttgtaatacctaatacaatgtaaatgctatgcaaatagttgttattgtttaaggaataatgacaagaaaaaaaagtctgtacatgctcagtaaagacacaaccatccctttttttccccagtgtttttgatccatggtttgctgaatccacagatgtggagcccctggatacggaaggcccgctgtactttgaatgacaaataa

SEQ ID NO: 69 - DNA, 969 bp, Artificial sequence
  Synthetic
atccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagctgagatctgcaagattgtaagacagcctgtgctccctcgctccttcctctgcattgcccctcttctccctctccaaacagagggaactctcctacccccaaggaggtgaaagctgctaccacctctgtgcccccccggtaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctggagaatgttgtgaggggtttatttttttttaatagtgttcataaagaaatacatagtattcttcttctcaagacgtggggggaaattatctcattatcgaggccctgctatgctgtgtgtctgggcgtgttgtatgtcctgctgccgatgccttcattaaaatgatttggaa

SEQ ID NO: 70 - DNA, 529 bp, Artificial sequence
  Synthetic
gatctgcaagattgtaagacagcctgtgctccctcgctccttcctctgcattgcccctcttctccctctccaaacagagggaactctcctacccccaaggaggtgaaagctgctaccacctctgtgcccccccggtaatgccaccaactggatcctacccgaatttatgattaagattgctgaagagctgccaaacactgctgccaccccctctgttcccttattgctgcttgtcactgcctgacattcacggcagaggcaaggctgctgcagcctcccctggctgtgcacattccctcctgctccccagagactgcctccgccatcccacagatgatggatcttcagtgggttctcttgggctctaggtcctggagaatgttgtgaggggtttatttttttttaatagtgttcataaagaaatacatagtattcttcttctcaagacgtggggggaaattatctcattatcgaggccctgctatgctgtgtgtctgggcgtgttgtatgtcctgctgccgatgccttc

SEQ ID NO: 71 - DNA, 751 bp, Artificial sequence
  Synthetic
gacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttctgaaggcagccctggaagtggagttaggagcttctaacccgtcatggttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaaccaataaaaatgttctggtctg

SEQ ID NO: 72 - DNA, 200 bp, Artificial sequence
  Synthetic
aggcagccctggaagtggagttaggagcttctaacccgtcatggttcaatacacattcttcttttgccagcgcttctgaagagctgctctcacctctctgcatcccaatagatatccccctatgtgcatgcacacctgcacactcacggctgaaatctccctaacccagggggaccttagcatgcctaagtgactaaacc

SEQ ID NO: 73 - DNA, 744 bp, Artificial sequence
  Synthetic
gacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaatggtgtgttgggc

SEQ ID NO: 74 - DNA, 309 bp, Artificial sequence
  Synthetic
atcctctatgagatcttgctagggaaggccaccttgtatgccgtgctggtcagtgccctcgtgctgatggccatggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaatggtgtgttgggc

SEQ ID NO: 75 - DNA, 22 bp, Artificial sequence
  Synthetic
ggaaaaacatccattctcattc

SEQ ID NO: 76 - DNA, 22 bp, Artificial sequence
  Synthetic
ttaaattacataatgtggcagt

SEQ ID NO: 77 - DNA, 22 bp, Artificial sequence
  Synthetic
tattttactgtgcatgggcttg

SEQ ID NO: 78 - DNA, 21 bp, Artificial sequence
  Synthetic
tgaatctgttgattgcagtga

SEQ ID NO: 79 - DNA, 21 bp, Artificial sequence
  Synthetic
ctgagatggtctgaactaaat

SEQ ID NO: 80 - DNA, 21 bp, Artificial sequence
  Synthetic
agatataggcaccatgtttga

SEQ ID NO: 81 - DNA, 22 bp, Artificial sequence
  Synthetic
ttggtcgtttatctcttccatc

SEQ ID NO: 82 - DNA, 22 bp, Artificial sequence
  Synthetic
ttcatctacagtttggctgaaa

SEQ ID NO: 83 - DNA, 22 bp, Artificial sequence
  Synthetic
ttaaattacacaatatggcagt

SEQ ID NO: 84 - DNA, 21 bp, Artificial sequence
  Synthetic
ttcatctacagtttggctgaa

SEQ ID NO: 85 - DNA, 21 bp, Artificial sequence
  Synthetic
accaattgaagcctatgtcag

SEQ ID NO: 86 - DNA, 21 bp, Artificial sequence
  Synthetic
tgaatctgttgactggagtga

SEQ ID NO: 87 - DNA, 22 bp, Artificial sequence
  Synthetic
ttaaacttcttgatttcccaaa

SEQ ID NO: 88 - DNA, 22 bp, Artificial sequence
  Synthetic
ttcaagtaaaatgagtatgtga

SEQ ID NO: 89 - DNA, 22 bp, Artificial sequence
  Synthetic
gagaaaaacaatctcaagactc

SEQ ID NO: 90 - DNA, 21 bp, Artificial sequence
  Synthetic
tatggtcgatggtctcaggag

SEQ ID NO: 91 - DNA, 21 bp, Artificial sequence
  Synthetic
aaacctgtggcccagctctta

SEQ ID NO: 92 - DNA, 21 bp, Artificial sequence
  Synthetic
aaatcattcagaggagccttt

SEQ ID NO: 93 - DNA, 22 bp, Artificial sequence
  Synthetic
tcctcttagatcatattccaag

SEQ ID NO: 94 - DNA, 22 bp, Artificial sequence
  Synthetic
tcaattagtgggatcacaaccc

SEQ ID NO: 95 - DNA, 21 bp, Artificial sequence
  Synthetic
ttaccaggaaagaccctggct

SEQ ID NO: 96 - DNA, 21 bp, Artificial sequence
  Synthetic
tgtagaagacatcacttcatc

SEQ ID NO: 97 - DNA, 21 bp, Artificial sequence
  Synthetic
aattagtgggatcacaaccca

SEQ ID NO: 98 - DNA, 22 bp, Artificial sequence
  Synthetic
taaatgtctcttactgtcatga

SEQ ID NO: 99 - DNA, 22 bp, Artificial sequence
  Synthetic
taaaacatcttgatttcacaaa

SEQ ID NO: 100 - DNA, 22 bp, Artificial sequence
  Synthetic
aatttcaagtaaagtgaatgtg

SEQ ID NO: 101 - DNA, 22 bp, Artificial sequence
  Synthetic
ttgttgtgtaacaacataattt

SEQ ID NO: 102 - DNA, 22 bp, Artificial sequence
  Synthetic
ttcactactgtgctggccccgc

SEQ ID NO: 103 - DNA, 22 bp, Artificial sequence
  Synthetic
tgggtctataagtagcacccag

SEQ ID NO: 104 - DNA, 22 bp, Artificial sequence
  Synthetic
tattacttgtaaacactggttc

SEQ ID NO: 105 - DNA, 22 bp, Artificial sequence
  Synthetic
tcttgtgtgttcattatcctag

SEQ ID NO: 106 - DNA, 22 bp, Artificial sequence
  Synthetic
tcatccatagaaaactcctcgg

SEQ ID NO: 107 - DNA, 22 bp, Artificial sequence
  Synthetic
ttacattcagaagtttcccctc

SEQ ID NO: 108 - DNA, 22 bp, Artificial sequence
  Synthetic
tgttttcagtgtatccatgagg

SEQ ID NO: 109 - DNA, 22 bp, Artificial sequence
  Synthetic
tatttcttcacaatgagcactc

SEQ ID NO: 110 - DNA, 22 bp, Artificial sequence
  Synthetic
tgaatcatcatgatagccgctt

SEQ ID NO: 111 - DNA, 22 bp, Artificial sequence
  Synthetic
ttttacttggtgtttatgcagg

SEQ ID NO: 112 - DNA, 22 bp, Artificial sequence
  Synthetic
tacaacatctactagatggctt

SEQ ID NO: 113 - DNA, 22 bp, Artificial sequence
  Synthetic
tttatgtcagagtctgactggt

SEQ ID NO: 114 - DNA, 22 bp, Artificial sequence
  Synthetic
ttgagttacaatgagacagctg

SEQ ID NO: 115 - DNA, 22 bp, Artificial sequence
  Synthetic
tattctgaccaataaaagcaag

SEQ ID NO: 116 - DNA, 22 bp, Artificial sequence
  Synthetic
ttttacctgaagaactagcagc

SEQ ID NO: 117 - DNA, 22 bp, Artificial sequence
  Synthetic
catttgcttgatgtttttgttc

SEQ ID NO: 118 - DNA, 22 bp, Artificial sequence
  Synthetic
tccttctccagtaccatcaacc

SEQ ID NO: 119 - DNA, 22 bp, Artificial sequence
  Synthetic
aggtaactcttctacacacttg

SEQ ID NO: 120 - DNA, 22 bp, Artificial sequence
  Synthetic
ttgtacttgaaaacttcacaga

SEQ ID NO: 121 - DNA, 22 bp, Artificial sequence
  Synthetic
taattagtttttgtattggaag

SEQ ID NO: 122 - DNA, 22 bp, Artificial sequence
  Synthetic
tggttttacctgaagaactagc

SEQ ID NO: 123 - DNA, 22 bp, Artificial sequence
  Synthetic
aaatataaaaatactactctgc

SEQ ID NO: 124 - DNA, 22 bp, Artificial sequence
  Synthetic
aattagaaatacacatatatcc

SEQ ID NO: 125 - DNA, 22 bp, Artificial sequence
  Synthetic
tcctttcttgttaaccaagctc

SEQ ID NO: 126 - DNA, 23 bp, Artificial sequence
  Synthetic
ctgctttagtgacatgctagtcc

SEQ ID NO: 127 - DNA, 21 bp, Artificial sequence
  Synthetic
agtaccatcaacccagatata

SEQ ID NO: 128 - DNA, 21 bp, Artificial sequence
  Synthetic
tacacgagtgccttaaattgg

SEQ ID NO: 129 - DNA, 21 bp, Artificial sequence
  Synthetic
aaagtaacctttcttctcctg

SEQ ID NO: 130 - DNA, 22 bp, Artificial sequence
  Synthetic
taaagtactagagccatcgaaa

SEQ ID NO: 131 - DNA, 22 bp, Artificial sequence
  Synthetic
tacaccagcagaaaagtcgttg

SEQ ID NO: 132 - DNA, 22 bp, Artificial sequence
  Synthetic
agttagacgtcgggcattgtcc

SEQ ID NO: 133 - DNA, 22 bp, Artificial sequence
  Synthetic
ttgtacttgaaaacttcacata

SEQ ID NO: 134 - DNA, 22 bp, Artificial sequence
  Synthetic
tatttaagtgggaacttgctga

SEQ ID NO: 135 - DNA, 22 bp, Artificial sequence
  Synthetic
ttaatttttgtactggaagggc

SEQ ID NO: 136 - DNA, 22 bp, Artificial sequence
  Synthetic
ttacaatcgggacaactgggag

SEQ ID NO: 137 - DNA, 22 bp, Artificial sequence
  Synthetic
tcattgagaagacacgtgcgga

SEQ ID NO: 138 - DNA, 22 bp, Artificial sequence
  Synthetic
aaaaaatttaatatcaaaaggc

SEQ ID NO: 139 - DNA, 22 bp, Artificial sequence
  Synthetic
actttgaacatactgtacatgg

SEQ ID NO: 140 - DNA, 21 bp, Artificial sequence
  Synthetic
catcgatccagatatacatgg

SEQ ID NO: 141 - DNA, 21 bp, Artificial sequence
  Synthetic
tccattatccgtttacaggtg

SEQ ID NO: 142 - DNA, 21 bp, Artificial sequence
  Synthetic
tgatgttggaggtttcatgga

SEQ ID NO: 143 - DNA, 22 bp, Artificial sequence
  Synthetic
taactcatagatctaaagccaa

SEQ ID NO: 144 - DNA, 22 bp, Artificial sequence
  Synthetic
tagagtacaacagttgcccagg

SEQ ID NO: 145 - DNA, 22 bp, Artificial sequence
  Synthetic
ttgtttagaattatacaggggc

SEQ ID NO: 146 - DNA, 22 bp, Artificial sequence
  Synthetic
aagaagaaaaacaatgtccata

SEQ ID NO: 147 - DNA, 22 bp, Artificial sequence
  Synthetic
aaatccaggacttttatccgag

SEQ ID NO: 148 - DNA, 22 bp, Artificial sequence
  Synthetic
tagtttcatataaacacccatt

SEQ ID NO: 149 - DNA, 22 bp, Artificial sequence
  Synthetic
tttagctacaaaaacattcaca

SEQ ID NO: 150 - DNA, 22 bp, Artificial sequence
  Synthetic
tattgtgaaatcaataaactgg

SEQ ID NO: 151 - DNA, 22 bp, Artificial sequence
  Synthetic
tgactgtacaaagcaatccatg

SEQ ID NO: 152 - DNA, 22 bp, Artificial sequence
  Synthetic
tattttgaaaatatagaactat

SEQ ID NO: 153 - DNA, 22 bp, Artificial sequence
  Synthetic
tgtattttctaataaaatggag

SEQ ID NO: 154 - DNA, 21 bp, Artificial sequence
  Synthetic
atgactatttcttccagagtg

SEQ ID NO: 155 - DNA, 21 bp, Artificial sequence
  Synthetic
aaacacttccctgaattcctc

SEQ ID NO: 156 - DNA, 21 bp, Artificial sequence
  Synthetic
ttgctaaggcagttactagag

SEQ ID NO: 157 - DNA, 21 bp, Artificial sequence
  Synthetic
ttatccgagacatctacagtt

SEQ ID NO: 158 - DNA, 22 bp, Artificial sequence
  Synthetic
tgtgtcactgctctctccgatg

SEQ ID NO: 159 - DNA, 22 bp, Artificial sequence
  Synthetic
ttgaggaagagactcagccccc

SEQ ID NO: 160 - DNA, 22 bp, Artificial sequence
  Synthetic
ttaccctggagcaagcaggtca

SEQ ID NO: 161 - DNA, 22 bp, Artificial sequence
  Synthetic
tcaggctctgagcagtgccttc

SEQ ID NO: 162 - DNA, 22 bp, Artificial sequence
  Synthetic
ttgttcacactggaaaaccgat

SEQ ID NO: 163 - DNA, 22 bp, Artificial sequence
  Synthetic
tagtcaactacttacacggaac

SEQ ID NO: 164 - DNA, 22 bp, Artificial sequence
  Synthetic
ttaccttaaaggaaactacttt

SEQ ID NO: 165 - DNA, 22 bp, Artificial sequence
  Synthetic
taaaacttaaaaatgtgctaag

SEQ ID NO: 166 - DNA, 22 bp, Artificial sequence
  Synthetic
taaaatagatgaatacatgatt

SEQ ID NO: 167 - DNA, 21 bp, Artificial sequence
  Synthetic
aaccgatgtgcacatctatgc

SEQ ID NO: 168 - DNA, 21 bp, Artificial sequence
  Synthetic
ttacacggaaccaacagtttc

SEQ ID NO: 169 - DNA, 21 bp, Artificial sequence
  Synthetic
tacagatgtcttcagcacagt

SEQ ID NO: 170 - DNA, 21 bp, Artificial sequence
  Synthetic
atgggtgtgtcactgctctct

SEQ ID NO: 171 - DNA, 22 bp, Artificial sequence
  Synthetic
tgagacatgagtcctgtggtgg

SEQ ID NO: 172 - DNA, 22 bp, Artificial sequence
  Synthetic
taggggacggtgacacctgctg

SEQ ID NO: 173 - DNA, 22 bp, Artificial sequence
  Synthetic
tgaagcagtgactgcatctggc

SEQ ID NO: 174 - DNA, 22 bp, Artificial sequence
  Synthetic
tccaaggccatctccaaccagc

SEQ ID NO: 175 - DNA, 22 bp, Artificial sequence
  Synthetic
ttctcctgaggaaatgcgctga

SEQ ID NO: 176 - DNA, 22 bp, Artificial sequence
  Synthetic
taaaggtggaggggtttcctgc

SEQ ID NO: 177 - DNA, 21 bp, Artificial sequence
  Synthetic
attgagacatgagtcctgtgg

SEQ ID NO: 178 - DNA, 21 bp, Artificial sequence
  Synthetic
acctgaagcagtgactgcatc

SEQ ID NO: 179 - DNA, 21 bp, Artificial sequence
  Synthetic
ttctcctgaggaaatgcgctg

SEQ ID NO: 180 - DNA, 21 bp, Artificial sequence
  Synthetic
ataatttcaggaatgggttcc

SEQ ID NO: 181 - DNA, 22 bp, Artificial sequence
  Synthetic
ttgtagtacacgtaatttgggt

SEQ ID NO: 182 - DNA, 22 bp, Artificial sequence
  Synthetic
ttgacccacatcataatgctgc

SEQ ID NO: 183 - DNA, 22 bp, Artificial sequence
  Synthetic
tacaatatagtcttctccctcg

SEQ ID NO: 184 - DNA, 22 bp, Artificial sequence
  Synthetic
tatatatgcaatacaaccttta

SEQ ID NO: 185 - DNA, 22 bp, Artificial sequence
  Synthetic
tagtgtttatattcaaaccatt

SEQ ID NO: 186 - DNA, 21 bp, Artificial sequence
  Synthetic
tgtagtacacgtaatttgggt

SEQ ID NO: 187 - DNA, 21 bp, Artificial sequence
  Synthetic
tgatgtgacagaaacatccca

SEQ ID NO: 188 - DNA, 21 bp, Artificial sequence
  Synthetic
ttccttgacccacatcataat

SEQ ID NO: 189 - DNA, 21 bp, Artificial sequence
  Synthetic
tacaatatagtcttctccctc

SEQ ID NO: 190 - DNA, 22 bp, Artificial sequence
  Synthetic
ttgtgtgtcagaattgtgctag

SEQ ID NO: 191 - DNA, 22 bp, Artificial sequence
  Synthetic
ttaagttcagtgcaggtcccag

SEQ ID NO: 192 - DNA, 22 bp, Artificial sequence
  Synthetic
ttgagctctaacatccatgatt

SEQ ID NO: 193 - DNA, 22 bp, Artificial sequence
  Synthetic
aaaaatacaacaaattagctgg

SEQ ID NO: 194 - DNA, 22 bp, Artificial sequence
  Synthetic
ttcaagatcaaggtagacctgg

SEQ ID NO: 195 - DNA, 22 bp, Artificial sequence
  Synthetic
taaatctcaacattccaaggga

SEQ ID NO: 196 - DNA, 21 bp, Artificial sequence
  Synthetic
ttcccatgtgagtcattatct

SEQ ID NO: 197 - DNA, 21 bp, Artificial sequence
  Synthetic
ttaagttcagtgcaggtccca

SEQ ID NO: 198 - DNA, 21 bp, Artificial sequence
  Synthetic
atgacatgcctgtttaagttc

SEQ ID NO: 199 - DNA, 21 bp, Artificial sequence
  Synthetic
aaatcatgaggtcaggagttt

SEQ ID NO: 200 - DNA, 22 bp, Artificial sequence
  Synthetic
ttacaaaaaacataaaggccgg

SEQ ID NO: 201 - DNA, 22 bp, Artificial sequence
  Synthetic
tgtatttacagcagcactgggc

SEQ ID NO: 202 - DNA, 22 bp, Artificial sequence
  Synthetic
tttatgtacatgtggaaggagg

SEQ ID NO: 203 - DNA, 22 bp, Artificial sequence
  Synthetic
ataaatgtcagaatctgtcatt

SEQ ID NO: 204 - DNA, 22 bp, Artificial sequence
  Synthetic
tatattaaatatattaatcaga

SEQ ID NO: 205 - DNA, 21 bp, Artificial sequence
  Synthetic
agaaggtggagtcattctgca

SEQ ID NO: 206 - DNA, 21 bp, Artificial sequence
  Synthetic
atgagagtgcgcatgtgcaca

SEQ ID NO: 207 - DNA, 21 bp, Artificial sequence
  Synthetic
cttatttacagcacggcgcta

SEQ ID NO: 208 - DNA, 21 bp, Artificial sequence
  Synthetic
tttacagcagcactgggctta

SEQ ID NO: 209 - DNA, 22 bp, Artificial sequence
  Synthetic
ttttctttagggatcaaggggg

SEQ ID NO: 210 - DNA, 22 bp, Artificial sequence
  Synthetic
tttcttctgaacaacaaactga

SEQ ID NO: 211 - DNA, 22 bp, Artificial sequence
  Synthetic
ttttactatatattacagcttt

SEQ ID NO: 212 - DNA, 22 bp, Artificial sequence
  Synthetic
taaatttacaagcctttgcctt

SEQ ID NO: 213 - DNA, 21 bp, Artificial sequence
  Synthetic
ttccattatcattccagttcc

SEQ ID NO: 214 - DNA, 21 bp, Artificial sequence
  Synthetic
atgccacccacgcaacattta

SEQ ID NO: 215 - DNA, 21 bp, Artificial sequence
  Synthetic
cattgggtaaatttacaagcc

SEQ ID NO: 216 - DNA, 21 bp, Artificial sequence
  Synthetic
ttcctttgaagtgcttgggag

SEQ ID NO: 217 - DNA, 22 bp, Artificial sequence
  Synthetic
taaatataaaacacaaccccaa

SEQ ID NO: 218 - DNA, 22 bp, Artificial sequence
  Synthetic
taaaacagttatattatccttt

SEQ ID NO: 219 - DNA, 22 bp, Artificial sequence
  Synthetic
ttgtttttaaatacaaagcaac

SEQ ID NO: 220 - DNA, 22 bp, Artificial sequence
  Synthetic
taatcctccatctttcaccatt

SEQ ID NO: 221 - DNA, 22 bp, Artificial sequence
  Synthetic
taggtttccaaacctatccctt

SEQ ID NO: 222 - DNA, 21 bp, Artificial sequence
  Synthetic
agtctttgctttctacaggag

SEQ ID NO: 223 - DNA, 21 bp, Artificial sequence
  Synthetic
tttaagacacatcctaccctg

SEQ ID NO: 224 - DNA, 21 bp, Artificial sequence
  Synthetic
aaacctatccctttgctgcgt

SEQ ID NO: 225 - DNA, 21 bp, Artificial sequence
  Synthetic
atttgtaggtaatcctccatc

SEQ ID NO: 226 - DNA, 22 bp, Artificial sequence
  Synthetic
tgagagtccgcttagtgcccat

SEQ ID NO: 227 - DNA, 22 bp, Artificial sequence
  Synthetic
aacaccattaagatcaaccagg

SEQ ID NO: 228 - DNA, 22 bp, Artificial sequence
  Synthetic
tgtctcatgtagaatgtgcttt

SEQ ID NO: 229 - DNA, 22 bp, Artificial sequence
  Synthetic
tcagtttctgtctctatcgagg

SEQ ID NO: 230 - DNA, 22 bp, Artificial sequence
  Synthetic
taacaggtgatcttgtctgggc

SEQ ID NO: 231 - DNA, 22 bp, Artificial sequence
  Synthetic
aataataataacaaacgcgtat

SEQ ID NO: 232 - DNA, 22 bp, Artificial sequence
  Synthetic
ttgtgttagcaggactgcgtgc

SEQ ID NO: 233 - DNA, 21 bp, Artificial sequence
  Synthetic
tacagaaggtgtcttgctata

SEQ ID NO: 234 - DNA, 21 bp, Artificial sequence
  Synthetic
ttaagtgagagtccgcttagt

SEQ ID NO: 235 - DNA, 21 bp, Artificial sequence
  Synthetic
ttaagatcaaccaggatgctc

SEQ ID NO: 236 - DNA, 21 bp, Artificial sequence
  Synthetic
tgaacatgaaaggagacagaa

SEQ ID NO: 237 - DNA, 21 bp, Artificial sequence
  Synthetic
tagattttaaacatccttgga

SEQ ID NO: 238 - DNA, 22 bp, Artificial sequence
  Synthetic
ttactcttgatgaagtttgttt

SEQ ID NO: 239 - DNA, 22 bp, Artificial sequence
  Synthetic
ttaatctttcatcctctgcata

SEQ ID NO: 240 - DNA, 22 bp, Artificial sequence
  Synthetic
taatatgacaccaataaactgt

SEQ ID NO: 241 - DNA, 21 bp, Artificial sequence
  Synthetic
atatgttggctcttcagcgct

SEQ ID NO: 242 - DNA, 21 bp, Artificial sequence
  Synthetic
ttagcatgccactgcatttac

SEQ ID NO: 243 - DNA, 21 bp, Artificial sequence
  Synthetic
tatgttagatgccagagcata

SEQ ID NO: 244 - DNA, 21 bp, Artificial sequence
  Synthetic
aaaccaagcagtatttacagc

SEQ ID NO: 245 - DNA, 22 bp, Artificial sequence
  Synthetic
tatgtcttaaagtaccctctgc

SEQ ID NO: 246 - DNA, 22 bp, Artificial sequence
  Synthetic
ttgaggtagcttcatagtggtt

SEQ ID NO: 247 - DNA, 22 bp, Artificial sequence
  Synthetic
taattcaattgcaactacctga

SEQ ID NO: 248 - DNA, 22 bp, Artificial sequence
  Synthetic
aaatataccatcttctcacttg

SEQ ID NO: 249 - DNA, 21 bp, Artificial sequence
  Synthetic
ataaattcaagcttgtcggca

SEQ ID NO: 250 - DNA, 21 bp, Artificial sequence
  Synthetic
aaaggactcaaattctgttgc

SEQ ID NO: 251 - DNA, 21 bp, Artificial sequence
  Synthetic
ttaaagtaccctctgcagcat

SEQ ID NO: 252 - DNA, 21 bp, Artificial sequence
  Synthetic
ctgactggaagtttgaggtag

SEQ ID NO: 253 - DNA, 22 bp, Artificial sequence
  Synthetic
tttcctgaaattaaaatcctgg

SEQ ID NO: 254 - DNA, 22 bp, Artificial sequence
  Synthetic
tacaaagagaaaattaatctta

SEQ ID NO: 255 - DNA, 22 bp, Artificial sequence
  Synthetic
tgtattaagtctattaacaagg

SEQ ID NO: 256 - DNA, 22 bp, Artificial sequence
  Synthetic
ttttgcatgaaaatctgcccta

SEQ ID NO: 257 - DNA, 21 bp, Artificial sequence
  Synthetic
attgcttctcagctagaatgt

SEQ ID NO: 258 - DNA, 21 bp, Artificial sequence
  Synthetic
attaatgagtgacccattgct

SEQ ID NO: 259 - DNA, 21 bp, Artificial sequence
  Synthetic
aattgcagtggacacagccat

SEQ ID NO: 260 - DNA, 21 bp, Artificial sequence
  Synthetic
atcacactcaatacccacatt

SEQ ID NO: 261 - DNA, 22 bp, Artificial sequence
  Synthetic
tatttttaaaaaattagccagg

SEQ ID NO: 262 - DNA, 22 bp, Artificial sequence
  Synthetic
tatctaaatagtaccatcggcc

SEQ ID NO: 263 - DNA, 22 bp, Artificial sequence
  Synthetic
ttagtaaataaacatagtgtta

SEQ ID NO: 264 - DNA, 22 bp, Artificial sequence
  Synthetic
ttaataaagtagaaaatctaga

SEQ ID NO: 265 - DNA, 22 bp, Artificial sequence
  Synthetic
tatcctatttaactttagctct

SEQ ID NO: 266 - DNA, 21 bp, Artificial sequence
  Synthetic
aacacagttattcacagtggc

SEQ ID NO: 267 - DNA, 21 bp, Artificial sequence
  Synthetic
tcatagttcacttcagtcagg

SEQ ID NO: 268 - DNA, 21 bp, Artificial sequence
  Synthetic
tgtgaaagtaggctgaggcat

SEQ ID NO: 269 - DNA, 21 bp, Artificial sequence
  Synthetic
taaatagggttgctcctctga

SEQ ID NO: 270 - DNA, 22 bp, Artificial sequence
  Synthetic
ttgtcgtcaatctggaagctgc

SEQ ID NO: 271 - DNA, 22 bp, Artificial sequence
  Synthetic
tagtgcagaggttaatccctgc

SEQ ID NO: 272 - DNA, 22 bp, Artificial sequence
  Synthetic
tttttgtttggcaccactcagg

SEQ ID NO: 273 - DNA, 22 bp, Artificial sequence
  Synthetic
tttcacttagaattcatagatt

SEQ ID NO: 274 - DNA, 22 bp, Artificial sequence
  Synthetic
ttgagttgcaggaaagtccagg

SEQ ID NO: 275 - DNA, 21 bp, Artificial sequence
  Synthetic
agcacttgtcgtcaatctgga

SEQ ID NO: 276 - DNA, 21 bp, Artificial sequence
  Synthetic
aatccacggcattcatctgtc

SEQ ID NO: 277 - DNA, 21 bp, Artificial sequence
  Synthetic
tctagagacaacacagggatc

SEQ ID NO: 278 - DNA, 21 bp, Artificial sequence
  Synthetic
ttgagttgcaggaaagtccag

SEQ ID NO: 279 - DNA, 22 bp, Artificial sequence
  Synthetic
ttcagaagtctcaactttgtgg

SEQ ID NO: 280 - DNA, 22 bp, Artificial sequence
  Synthetic
ttttagaagtatgtttacgatg

SEQ ID NO: 281 - DNA, 22 bp, Artificial sequence
  Synthetic
tttctaaataaagaaaatggga

SEQ ID NO: 282 - DNA, 22 bp, Artificial sequence
  Synthetic
ttaaattgtttaaccatccgct

SEQ ID NO: 283 - DNA, 21 bp, Artificial sequence
  Synthetic
ttcagaagtctcaactttgtg

SEQ ID NO: 284 - DNA, 21 bp, Artificial sequence
  Synthetic
aagagtgccacgttcagaagt

SEQ ID NO: 285 - DNA, 21 bp, Artificial sequence
  Synthetic
agaaagatgacacaggtacac

SEQ ID NO: 286 - DNA, 21 bp, Artificial sequence
  Synthetic
ttaaccatccgcttgtagttc

SEQ ID NO: 287 - DNA, 22 bp, Artificial sequence
  Synthetic
taatttttgtatttttttgtaa

SEQ ID NO: 288 - DNA, 22 bp, Artificial sequence
  Synthetic
tgtattaactcctaacacctaa

SEQ ID NO: 289 - DNA, 22 bp, Artificial sequence
  Synthetic
ttatcttgagacagagtcttgc

SEQ ID NO: 290 - DNA, 22 bp, Artificial sequence
  Synthetic
ttaaaaaaaaaaaaaacctaat

SEQ ID NO: 291 - DNA, 21 bp, Artificial sequence
  Synthetic
tgaacttctgacctcaagtga

SEQ ID NO: 292 - DNA, 21 bp, Artificial sequence
  Synthetic
taaagacggcatttcacgatg

SEQ ID NO: 293 - DNA, 21 bp, Artificial sequence
  Synthetic
aatatatgcacacaccatcac

SEQ ID NO: 294 - DNA, 21 bp, Artificial sequence
  Synthetic
tgcaatctcagctcactgcct

SEQ ID NO: 295 - DNA, 22 bp, Artificial sequence
  Synthetic
aaaagttacaggatgttccatc

SEQ ID NO: 296 - DNA, 22 bp, Artificial sequence
  Synthetic
tgtgaaaacaatgacatcccaa

SEQ ID NO: 297 - DNA, 22 bp, Artificial sequence
  Synthetic
ttacattaggataaaaaagtgc

SEQ ID NO: 298 - DNA, 22 bp, Artificial sequence
  Synthetic
tcatatagtatcaagtgaagtc

SEQ ID NO: 299 - DNA, 22 bp, Artificial sequence
  Synthetic
aaatacaaaaaattagccgggc

SEQ ID NO: 300 - DNA, 21 bp, Artificial sequence
  Synthetic
aaacaatgacatcccaaacca

SEQ ID NO: 301 - DNA, 21 bp, Artificial sequence
  Synthetic
atcaagtgaagtcggacaacg

SEQ ID NO: 302 - DNA, 21 bp, Artificial sequence
  Synthetic
aattgtggcactttcctactg

SEQ ID NO: 303 - DNA, 21 bp, Artificial sequence
  Synthetic
tgtagaagttgccaatcattg

SEQ ID NO: 304 - DNA, 22 bp, Artificial sequence
  Synthetic
tacattaatattattcatccaa

SEQ ID NO: 305 - DNA, 22 bp, Artificial sequence
  Synthetic
ttgcatcctaaggacaaactgt

SEQ ID NO: 306 - DNA, 22 bp, Artificial sequence
  Synthetic
taaaataccaatttcttccaaa

SEQ ID NO: 307 - DNA, 22 bp, Artificial sequence
  Synthetic
tttaggagaacaaaaccccctt

SEQ ID NO: 308 - DNA, 22 bp, Artificial sequence
  Synthetic
ttaaagagtgcaaaaaacctct

SEQ ID NO: 309 - DNA, 22 bp, Artificial sequence
  Synthetic
ttcattagaatttttttccaat

SEQ ID NO: 310 - DNA, 21 bp, Artificial sequence
  Synthetic
ttcatttgcatcctaaggaca

SEQ ID NO: 311 - DNA, 21 bp, Artificial sequence
  Synthetic
tttaccaacagtacaacaagg

SEQ ID NO: 312 - DNA, 21 bp, Artificial sequence
  Synthetic
aaatgctgcagactatgcaca

SEQ ID NO: 313 - DNA, 21 bp, Artificial sequence
  Synthetic
atgaatgcaatactgcacaac

SEQ ID NO: 314 - DNA, 22 bp, Artificial sequence
  Synthetic
taactttggagttccttcttta

SEQ ID NO: 315 - DNA, 22 bp, Artificial sequence
  Synthetic
ttaagaaacaaaataagtgttt

SEQ ID NO: 316 - DNA, 22 bp, Artificial sequence
  Synthetic
tatatatatatatatggccttt

SEQ ID NO: 317 - DNA, 22 bp, Artificial sequence
  Synthetic
ttatgtacaagccacttcctac

SEQ ID NO: 318 - DNA, 22 bp, Artificial sequence
  Synthetic
tttgctgtcgagagagctttgc

SEQ ID NO: 319 - DNA, 21 bp, Artificial sequence
  Synthetic
tccttctttaattccagaggt

SEQ ID NO: 320 - DNA, 21 bp, Artificial sequence
  Synthetic
atgccctgagatttcagtaac

SEQ ID NO: 321 - DNA, 21 bp, Artificial sequence
  Synthetic
ttatgtacaagccacttccta

SEQ ID NO: 322 - DNA, 21 bp, Artificial sequence
  Synthetic
tgtcgagagagctttgcagag

SEQ ID NO: 323 - DNA, 22 bp, Artificial sequence
  Synthetic
ttaagacccaagcactaacatg

SEQ ID NO: 324 - DNA, 22 bp, Artificial sequence
  Synthetic
tttccctacaagtctttccaat

SEQ ID NO: 325 - DNA, 22 bp, Artificial sequence
  Synthetic
tttgacatcctgttgagcccag

SEQ ID NO: 326 - DNA, 22 bp, Artificial sequence
  Synthetic
ttctaaagtaaaaattctcaaa

SEQ ID NO: 327 - DNA, 21 bp, Artificial sequence
  Synthetic
aatgatgtcaacatgctgatc

SEQ ID NO: 328 - DNA, 21 bp, Artificial sequence
  Synthetic
tcctatggacccttaagaccc

SEQ ID NO: 329 - DNA, 21 bp, Artificial sequence
  Synthetic
tttcttgccagtcttgagttc

SEQ ID NO: 330 - DNA, 21 bp, Artificial sequence
  Synthetic
tatggatgcatattctgttgg

SEQ ID NO: 331 - DNA, 22 bp, Artificial sequence
  Synthetic
ttggtcgccactgtcttctcca

SEQ ID NO: 332 - DNA, 22 bp, Artificial sequence
  Synthetic
tctaaggcagaaaatcgtcttg

SEQ ID NO: 333 - DNA, 22 bp, Artificial sequence
  Synthetic
tatcttgctctgagcctgcgga

SEQ ID NO: 334 - DNA, 22 bp, Artificial sequence
  Synthetic
tccaggtcagagctgctccggc

SEQ ID NO: 335 - DNA, 21 bp, Artificial sequence
  Synthetic
ctagacagctctgtgaagtac

SEQ ID NO: 336 - DNA, 21 bp, Artificial sequence
  Synthetic
aaaggtgaaagccaaaggctc

SEQ ID NO: 337 - DNA, 21 bp, Artificial sequence
  Synthetic
ttcttgctccagctcctctat

SEQ ID NO: 338 - DNA, 21 bp, Artificial sequence
  Synthetic
atgagaaacagcaggaggtgg

SEQ ID NO: 339 - DNA, 22 bp, Artificial sequence
  Synthetic
aaggatgagaaacagcaggagg

SEQ ID NO: 340 - DNA, 22 bp, Artificial sequence
  Synthetic
tgtatcttccagaagatgcctc

SEQ ID NO: 341 - DNA, 22 bp, Artificial sequence
  Synthetic
tatattcatctataatagcaaa

SEQ ID NO: 342 - DNA, 22 bp, Artificial sequence
  Synthetic
tacacacacacacacacacgca

SEQ ID NO: 343 - DNA, 21 bp, Artificial sequence
  Synthetic
aagtgtatcttccagaagatg

SEQ ID NO: 344 - DNA, 21 bp, Artificial sequence
  Synthetic
cttacttataacctgcctttg

SEQ ID NO: 345 - DNA, 21 bp, Artificial sequence
  Synthetic
ttaactgtaagttcttgaggg

SEQ ID NO: 346 - DNA, 21 bp, Artificial sequence
  Synthetic
tgtatcttccagaagatgcct

SEQ ID NO: 347 - DNA, 22 bp, Artificial sequence
  Synthetic
tagaattataaagaagatcatg

SEQ ID NO: 348 - DNA, 22 bp, Artificial sequence
  Synthetic
ttaactatcttaacaagctttg

SEQ ID NO: 349 - DNA, 22 bp, Artificial sequence
  Synthetic
ttcattataacaaatttccaat

SEQ ID NO: 350 - DNA, 22 bp, Artificial sequence
  Synthetic
taagaagtaaatatgaatctta

SEQ ID NO: 351 - DNA, 21 bp, Artificial sequence
  Synthetic
tccaaatgcggcatcttcaaa

SEQ ID NO: 352 - DNA, 21 bp, Artificial sequence
  Synthetic
caaacatggagacagcactca

SEQ ID NO: 353 - DNA, 21 bp, Artificial sequence
  Synthetic
taagttgccagccctcctaga

SEQ ID NO: 354 - DNA, 21 bp, Artificial sequence
  Synthetic
ttaaccacaaccatgccttac

SEQ ID NO: 355 - DNA, 22 bp, Artificial sequence
  Synthetic
aatcttaatcataaattcgggt

SEQ ID NO: 356 - DNA, 22 bp, Artificial sequence
  Synthetic
tgaagatccatcatctgtggga

SEQ ID NO: 357 - DNA, 22 bp, Artificial sequence
  Synthetic
ttctccaggacctagagcccaa

SEQ ID NO: 358 - DNA, 22 bp, Artificial sequence
  Synthetic
tatttctttatgaacactatta

SEQ ID NO: 359 - DNA, 21 bp, Artificial sequence
  Synthetic
agtgtttggcagctcttcagc

SEQ ID NO: 360 - DNA, 21 bp, Artificial sequence
  Synthetic
aacattctccaggacctagag

SEQ ID NO: 361 - DNA, 21 bp, Artificial sequence
  Synthetic
catacaacacgcccagacaca

SEQ ID NO: 362 - DNA, 21 bp, Artificial sequence
  Synthetic
atcggcagcaggacatacaac

SEQ ID NO: 363 - DNA, 22 bp, Artificial sequence
  Synthetic
tagaagctcctaactccacttc

SEQ ID NO: 364 - DNA, 22 bp, Artificial sequence
  Synthetic
tgtgtattgaaccatgacgggt

SEQ ID NO: 365 - DNA, 22 bp, Artificial sequence
  Synthetic
tagggggatatctattgggatg

SEQ ID NO: 366 - DNA, 22 bp, Artificial sequence
  Synthetic
tttagtcacttaggcatgctaa

SEQ ID NO: 367 - DNA, 21 bp, Artificial sequence
  Synthetic
agaagctcctaactccacttc

SEQ ID NO: 368 - DNA, 21 bp, Artificial sequence
  Synthetic
tattgaaccatgacgggttag

SEQ ID NO: 369 - DNA, 21 bp, Artificial sequence
  Synthetic
atatctattgggatgcagaga

SEQ ID NO: 370 - DNA, 21 bp, Artificial sequence
  Synthetic
tagtcacttaggcatgctaag

SEQ ID NO: 371 - DNA, 22 bp, Artificial sequence
  Synthetic
tggttttggagctagcctctgg

SEQ ID NO: 372 - DNA, 22 bp, Artificial sequence
  Synthetic
tttaggaacacagattgggagc

SEQ ID NO: 373 - DNA, 22 bp, Artificial sequence
  Synthetic
taagtaggagatgagaagcaga

SEQ ID NO: 374 - DNA, 22 bp, Artificial sequence
  Synthetic
tagcctatttcgtacttggggg

SEQ ID NO: 375 - DNA, 21 bp, Artificial sequence
  Synthetic
tgaggatgaagaatgacctgg

SEQ ID NO: 376 - DNA, 21 bp, Artificial sequence
  Synthetic
attgggagcaggtacaggaga

SEQ ID NO: 377 - DNA, 21 bp, Artificial sequence
  Synthetic
atgagaagcagagtgagaatc

SEQ ID NO: 378 - DNA, 21 bp, Artificial sequence
  Synthetic
tggtttagcctatttcgtact

SEQ ID NO: 379 - DNA, 22 bp, Artificial sequence
  Synthetic
gaatgagaatagatgtttttca

SEQ ID NO: 380 - DNA, 22 bp, Artificial sequence
  Synthetic
actgccacatcatgtaatttac

SEQ ID NO: 381 - DNA, 22 bp, Artificial sequence
  Synthetic
caagcccatgaacagtaaaatc

SEQ ID NO: 382 - DNA, 19 bp, Artificial sequence
  Synthetic
tcactgcacaacagattca

SEQ ID NO: 383 - DNA, 19 bp, Artificial sequence
  Synthetic
atttagttgaccatctcag

SEQ ID NO: 384 - DNA, 19 bp, Artificial sequence
  Synthetic
tcaaacattgcctatatct

SEQ ID NO: 385 - DNA, 22 bp, Artificial sequence
  Synthetic
gatggaagagctaaacgaccac

SEQ ID NO: 386 - DNA, 22 bp, Artificial sequence
  Synthetic
tttcagccaacctgtagatgac

SEQ ID NO: 387 - DNA, 22 bp, Artificial sequence
  Synthetic
actgccatatcgtgtaatttac

SEQ ID NO: 388 - DNA, 19 bp, Artificial sequence
  Synthetic
ttcagccactgtagatgaa

SEQ ID NO: 389 - DNA, 19 bp, Artificial sequence
  Synthetic
ctgacatacttcaattggt

SEQ ID NO: 390 - DNA, 19 bp, Artificial sequence
  Synthetic
tcactccacaacagattca

SEQ ID NO: 391 - DNA, 22 bp, Artificial sequence
  Synthetic
tttgggaaataaagaagtttac

SEQ ID NO: 392 - DNA, 22 bp, Artificial sequence
  Synthetic
tcacatactccttttacttgac

SEQ ID NO: 393 - DNA, 22 bp, Artificial sequence
  Synthetic
gagtcttgagcttgtttttcta

SEQ ID NO: 394 - DNA, 19 bp, Artificial sequence
  Synthetic
ctcctgagcatcgaccata

SEQ ID NO: 395 - DNA, 19 bp, Artificial sequence
  Synthetic
taagagctgccacaggttt

SEQ ID NO: 396 - DNA, 19 bp, Artificial sequence
  Synthetic
aaaggctcctgaatgattt

SEQ ID NO: 397 - DNA, 22 bp, Artificial sequence
  Synthetic
cttggaatataatctaagaggc

SEQ ID NO: 398 - DNA, 22 bp, Artificial sequence
  Synthetic
gggttgtgataccactaattgc

SEQ ID NO: 399 - DNA, 19 bp, Artificial sequence
  Synthetic
agccagggtttcctggtaa

SEQ ID NO: 400 - DNA, 19 bp, Artificial sequence
  Synthetic
gatgaagttgtcttctaca

SEQ ID NO: 401 - DNA, 19 bp, Artificial sequence
  Synthetic
tgggttgttcccactaatt

SEQ ID NO: 402 - DNA, 22 bp, Artificial sequence
  Synthetic
tcatgacagtcagagacatttc

SEQ ID NO: 403 - DNA, 22 bp, Artificial sequence
  Synthetic
tttgtgaaataaagatgttttc

SEQ ID NO: 404 - DNA, 22 bp, Artificial sequence
  Synthetic
cacattcactctacttgaaatc

SEQ ID NO: 405 - DNA, 22 bp, Artificial sequence
  Synthetic
aaattatgttattacacaacac

SEQ ID NO: 406 - DNA, 22 bp, Artificial sequence
  Synthetic
gcggggccagaacagtagtgac

SEQ ID NO: 407 - DNA, 22 bp, Artificial sequence
  Synthetic
ctgggtgctaattatagacccc

SEQ ID NO: 408 - DNA, 22 bp, Artificial sequence
  Synthetic
gaaccagtgtctacaagtaatc

SEQ ID NO: 409 - DNA, 22 bp, Artificial sequence
  Synthetic
ctaggataataaacacacaagc

SEQ ID NO: 410 - DNA, 22 bp, Artificial sequence
  Synthetic
ccgaggagttctctatggatgc

SEQ ID NO: 411 - DNA, 22 bp, Artificial sequence
  Synthetic
gaggggaaacctctgaatgtac

SEQ ID NO: 412 - DNA, 22 bp, Artificial sequence
  Synthetic
cctcatggatccactgaaaacc

SEQ ID NO: 413 - DNA, 22 bp, Artificial sequence
  Synthetic
gagtgctcatcgtgaagaaatc

SEQ ID NO: 414 - DNA, 22 bp, Artificial sequence
  Synthetic
aagcggctataatgatgattcc

SEQ ID NO: 415 - DNA, 22 bp, Artificial sequence
  Synthetic
cctgcataaaaaccaagtaaac

SEQ ID NO: 416 - DNA, 22 bp, Artificial sequence
  Synthetic
aagccatctaatagatgttgtc

SEQ ID NO: 417 - DNA, 22 bp, Artificial sequence
  Synthetic
accagtcagaatctgacataac

SEQ ID NO: 418 - DNA, 22 bp, Artificial sequence
  Synthetic
cagctgtctccttgtaactcac

SEQ ID NO: 419 - DNA, 22 bp, Artificial sequence
  Synthetic
cttgcttttactggtcagaatc

SEQ ID NO: 420 - DNA, 22 bp, Artificial sequence
  Synthetic
gctgctagttattcaggtaaac

SEQ ID NO: 421 - DNA, 22 bp, Artificial sequence
  Synthetic
gaacaaaaacctcaagcaaata

SEQ ID NO: 422 - DNA, 22 bp, Artificial sequence
  Synthetic
ggttgatggtcctggagaaggc

SEQ ID NO: 423 - DNA, 22 bp, Artificial sequence
  Synthetic
caagtgtgtagacgagttaccc

SEQ ID NO: 424 - DNA, 22 bp, Artificial sequence
  Synthetic
tctgtgaagtcttcaagtacac

SEQ ID NO: 425 - DNA, 22 bp, Artificial sequence
  Synthetic
cttccaataccaaaactaattc

SEQ ID NO: 426 - DNA, 22 bp, Artificial sequence
  Synthetic
gctagttcttaaggtaaaaccc

SEQ ID NO: 427 - DNA, 22 bp, Artificial sequence
  Synthetic
gcagagtagtctttttatattc

SEQ ID NO: 428 - DNA, 22 bp, Artificial sequence
  Synthetic
ggatatatgtatatttctaatc

SEQ ID NO: 429 - DNA, 22 bp, Artificial sequence
  Synthetic
gagcttggttcacaagaaaggc

SEQ ID NO: 430 - DNA, 23 bp, Artificial sequence
  Synthetic
ggactagcatgacactaaagcaa

SEQ ID NO: 431 - DNA, 19 bp, Artificial sequence
  Synthetic
tatatctgttgatggtact

SEQ ID NO: 432 - DNA, 19 bp, Artificial sequence
  Synthetic
ccaatttagcactcgtgta

SEQ ID NO: 433 - DNA, 19 bp, Artificial sequence
  Synthetic
caggagaaaaggttacttt

SEQ ID NO: 434 - DNA, 22 bp, Artificial sequence
  Synthetic
tttcgatggccctagtactttc

SEQ ID NO: 435 - DNA, 22 bp, Artificial sequence
  Synthetic
caacgactttcctgctggtgtc

SEQ ID NO: 436 - DNA, 22 bp, Artificial sequence
  Synthetic
ggacaatgccagacgtctaacc

SEQ ID NO: 437 - DNA, 22 bp, Artificial sequence
  Synthetic
tatgtgaagtcttcaagtacac

SEQ ID NO: 438 - DNA, 22 bp, Artificial sequence
  Synthetic
tcagcaagttaccacttaaatc

SEQ ID NO: 439 - DNA, 22 bp, Artificial sequence
  Synthetic
gcccttccagcacaaaaattac

SEQ ID NO: 440 - DNA, 22 bp, Artificial sequence
  Synthetic
ctcccagttgccccgattgtac

SEQ ID NO: 441 - DNA, 22 bp, Artificial sequence
  Synthetic
tccgcacgtgccttctcaatgc

SEQ ID NO: 442 - DNA, 22 bp, Artificial sequence
  Synthetic
gccttttgatcttaaatttttc

SEQ ID NO: 443 - DNA, 22 bp, Artificial sequence
  Synthetic
ccatgtacagcatgttcaaagc

SEQ ID NO: 444 - DNA, 19 bp, Artificial sequence
  Synthetic
ccatgtatctggatcgatg

SEQ ID NO: 445 - DNA, 19 bp, Artificial sequence
  Synthetic
cacctgtacggataatgga

SEQ ID NO: 446 - DNA, 19 bp, Artificial sequence
  Synthetic
tccatgaactccaacatca

SEQ ID NO: 447 - DNA, 22 bp, Artificial sequence
  Synthetic
ttggctttagctctatgagttc

SEQ ID NO: 448 - DNA, 22 bp, Artificial sequence
  Synthetic
cctgggcaaccgttgtactctc

SEQ ID NO: 449 - DNA, 22 bp, Artificial sequence
  Synthetic
gcccctgtatcattctaaacac

SEQ ID NO: 450 - DNA, 22 bp, Artificial sequence
  Synthetic
tatggacattatttttcttctc

SEQ ID NO: 451 - DNA, 22 bp, Artificial sequence
  Synthetic
ctcggataaacgtcctggattc

SEQ ID NO: 452 - DNA, 22 bp, Artificial sequence
  Synthetic
aatgggtgttcatatgaaactc

SEQ ID NO: 453 - DNA, 22 bp, Artificial sequence
  Synthetic
tgtgaatgttcttgtagctaac

SEQ ID NO: 454 - DNA, 22 bp, Artificial sequence
  Synthetic
ccagtttattaatttcacaatc

SEQ ID NO: 455 - DNA, 22 bp, Artificial sequence
  Synthetic
catggattgccttgtacagtcc

SEQ ID NO: 456 - DNA, 22 bp, Artificial sequence
  Synthetic
atagttctatcttttcaaaatc

SEQ ID NO: 457 - DNA, 22 bp, Artificial sequence
  Synthetic
ctccattttactagaaaatacc

SEQ ID NO: 458 - DNA, 19 bp, Artificial sequence
  Synthetic
cactctgggaaatagtcat

SEQ ID NO: 459 - DNA, 19 bp, Artificial sequence
  Synthetic
gaggaattgggaagtgttt

SEQ ID NO: 460 - DNA, 19 bp, Artificial sequence
  Synthetic
ctctagtatgccttagcaa

SEQ ID NO: 461 - DNA, 19 bp, Artificial sequence
  Synthetic
aactgtaggtctcggataa

SEQ ID NO: 462 - DNA, 22 bp, Artificial sequence
  Synthetic
catcggagagcgcagtgacacc

SEQ ID NO: 463 - DNA, 22 bp, Artificial sequence
  Synthetic
gggggctgagcctcttcctcac

SEQ ID NO: 464 - DNA, 22 bp, Artificial sequence
  Synthetic
tgacctgcttactccagggtac

SEQ ID NO: 465 - DNA, 22 bp, Artificial sequence
  Synthetic
gaaggcactgatcagagcctgc

SEQ ID NO: 466 - DNA, 22 bp, Artificial sequence
  Synthetic
atcggttttcaagtgtgaacac

SEQ ID NO: 467 - DNA, 22 bp, Artificial sequence
  Synthetic
gttccgtgtacgtagttgactc

SEQ ID NO: 468 - DNA, 22 bp, Artificial sequence
  Synthetic
aaagtagtttactttaaggtac

SEQ ID NO: 469 - DNA, 22 bp, Artificial sequence
  Synthetic
cttagcacatctttaagttttc

SEQ ID NO: 470 - DNA, 22 bp, Artificial sequence
  Synthetic
aatcatgtatccatctattttc

SEQ ID NO: 471 - DNA, 19 bp, Artificial sequence
  Synthetic
gcatagatgcacatcggtt

SEQ ID NO: 472 - DNA, 19 bp, Artificial sequence
  Synthetic
gaaactgtgttccgtgtaa

SEQ ID NO: 473 - DNA, 19 bp, Artificial sequence
  Synthetic
actgtgctagacatctgta

SEQ ID NO: 474 - DNA, 19 bp, Artificial sequence
  Synthetic
agagagcagacacacccat

SEQ ID NO: 475 - DNA, 22 bp, Artificial sequence
  Synthetic
ccaccacaggcctcatgtctcc

SEQ ID NO: 476 - DNA, 22 bp, Artificial sequence
  Synthetic
cagcaggtgtaaccgtcccctc

SEQ ID NO: 477 - DNA, 22 bp, Artificial sequence
  Synthetic
gccagatgcaatcactgcttcc

SEQ ID NO: 478 - DNA, 22 bp, Artificial sequence
  Synthetic
gctggttggaaatggccttggc

SEQ ID NO: 479 - DNA, 22 bp, Artificial sequence
  Synthetic
tcagcgcattccctcaggagac

SEQ ID NO: 480 - DNA, 22 bp, Artificial sequence
  Synthetic
gcaggaaaccactccacctttc

SEQ ID NO: 481 - DNA, 19 bp, Artificial sequence
  Synthetic
ccacaggacatgtctcaat

SEQ ID NO: 482 - DNA, 19 bp, Artificial sequence
  Synthetic
gatgcagtctgcttcaggt

SEQ ID NO: 483 - DNA, 19 bp, Artificial sequence
  Synthetic
cagcgcatcctcaggagaa

SEQ ID NO: 484 - DNA, 19 bp, Artificial sequence
  Synthetic
ggaacccacctgaaattat

SEQ ID NO: 485 - DNA, 22 bp, Artificial sequence
  Synthetic
acccaaattaagtgtactacac

SEQ ID NO: 486 - DNA, 22 bp, Artificial sequence
  Synthetic
gcagcattataatgtgggtcac

SEQ ID NO: 487 - DNA, 22 bp, Artificial sequence
  Synthetic
cgagggagaaaactatattgtc

SEQ ID NO: 488 - DNA, 22 bp, Artificial sequence
  Synthetic
taaaggttgtcttgcatatatc

SEQ ID NO: 489 - DNA, 22 bp, Artificial sequence
  Synthetic
aatggtttgactataaacactc

SEQ ID NO: 490 - DNA, 19 bp, Artificial sequence
  Synthetic
acccaaatcgtgtactaca

SEQ ID NO: 491 - DNA, 19 bp, Artificial sequence
  Synthetic
tgggatgtctgtcacatca

SEQ ID NO: 492 - DNA, 19 bp, Artificial sequence
  Synthetic
attatgatgggtcaaggaa

SEQ ID NO: 493 - DNA, 19 bp, Artificial sequence
  Synthetic
gagggagaactatattgta

SEQ ID NO: 494 - DNA, 22 bp, Artificial sequence
  Synthetic
ctagcacaatcctgacacacac

SEQ ID NO: 495 - DNA, 22 bp, Artificial sequence
  Synthetic
ctgggacctgaactgaacttac

SEQ ID NO: 496 - DNA, 22 bp, Artificial sequence
  Synthetic
aatcatggatattagagctcac

SEQ ID NO: 497 - DNA, 22 bp, Artificial sequence
  Synthetic
ccagctaattcgttgtattttc

SEQ ID NO: 498 - DNA, 22 bp, Artificial sequence
  Synthetic
ccaggtctacattgatcttgac

SEQ ID NO: 499 - DNA, 22 bp, Artificial sequence
  Synthetic
tcccttggaacgttgagatttc

SEQ ID NO: 500 - DNA, 19 bp, Artificial sequence
  Synthetic
agataatgtcacatgggaa

SEQ ID NO: 501 - DNA, 19 bp, Artificial sequence
  Synthetic
tgggacctactgaacttaa

SEQ ID NO: 502 - DNA, 19 bp, Artificial sequence
  Synthetic
gaacttaaaggcatgtcat

SEQ ID NO: 503 - DNA, 19 bp, Artificial sequence
  Synthetic
aaactcctcctcatgattt

SEQ ID NO: 504 - DNA, 22 bp, Artificial sequence
  Synthetic
ccggcctttacgttttttgtac

SEQ ID NO: 505 - DNA, 22 bp, Artificial sequence
  Synthetic
gcccagtgctactgtaaatacc

SEQ ID NO: 506 - DNA, 22 bp, Artificial sequence
  Synthetic
cctccttccaaatgtacataac

SEQ ID NO: 507 - DNA, 22 bp, Artificial sequence
  Synthetic
aatgacagatcctgacatttac

SEQ ID NO: 508 - DNA, 22 bp, Artificial sequence
  Synthetic
tctgattaatctatttaatatc

SEQ ID NO: 509 - DNA, 19 bp, Artificial sequence
  Synthetic
tgcagaatctccaccttct

SEQ ID NO: 510 - DNA, 19 bp, Artificial sequence
  Synthetic
tgtgcacacgcactctcat

SEQ ID NO: 511 - DNA, 19 bp, Artificial sequence
  Synthetic
tagcgccgctgtaaataag

SEQ ID NO: 512 - DNA, 19 bp, Artificial sequence
  Synthetic
taagcccagctgctgtaaa

SEQ ID NO: 513 - DNA, 22 bp, Artificial sequence
  Synthetic
cccccttgatacctaaagaaac

SEQ ID NO: 514 - DNA, 22 bp, Artificial sequence
  Synthetic
tcagtttgttattcagaagaac

SEQ ID NO: 515 - DNA, 22 bp, Artificial sequence
  Synthetic
aaagctgtaacatatagtaaac

SEQ ID NO: 516 - DNA, 22 bp, Artificial sequence
  Synthetic
aaggcaaaggattgtaaatttc

SEQ ID NO: 517 - DNA, 19 bp, Artificial sequence
  Synthetic
ggaactggtgataatggaa

SEQ ID NO: 518 - DNA, 19 bp, Artificial sequence
  Synthetic
taaatgttgtgggtggcat

SEQ ID NO: 519 - DNA, 19 bp, Artificial sequence
  Synthetic
ggcttgtatttacccaatg

SEQ ID NO: 520 - DNA, 19 bp, Artificial sequence
  Synthetic
ctcccaagcttcaaaggaa

SEQ ID NO: 521 - DNA, 22 bp, Artificial sequence
  Synthetic
ttggggttgtattttatatttc

SEQ ID NO: 522 - DNA, 22 bp, Artificial sequence
  Synthetic
aaaggataatctaactgttttc

SEQ ID NO: 523 - DNA, 22 bp, Artificial sequence
  Synthetic
gttgctttgtctttaaaaacac

SEQ ID NO: 524 - DNA, 22 bp, Artificial sequence
  Synthetic
aatggtgaaaaatggaggattc

SEQ ID NO: 525 - DNA, 22 bp, Artificial sequence
  Synthetic
aagggataggcttggaaacctc

SEQ ID NO: 526 - DNA, 19 bp, Artificial sequence
  Synthetic
ctcctgtaaagcaaagact

SEQ ID NO: 527 - DNA, 19 bp, Artificial sequence
  Synthetic
cagggtagtgtgtcttaaa

SEQ ID NO: 528 - DNA, 19 bp, Artificial sequence
  Synthetic
acgcagcagggataggttt

SEQ ID NO: 529 - DNA, 19 bp, Artificial sequence
  Synthetic
gatggaggtacctacaaat

SEQ ID NO: 530 - DNA, 22 bp, Artificial sequence
  Synthetic
atgggcactacgcggactctcc

SEQ ID NO: 531 - DNA, 22 bp, Artificial sequence
  Synthetic
cctggttgatattaatggtgtc

SEQ ID NO: 532 - DNA, 22 bp, Artificial sequence
  Synthetic
aaagcacattatacatgagacc

SEQ ID NO: 533 - DNA, 22 bp, Artificial sequence
  Synthetic
cctcgatagaaacagaaactgc

SEQ ID NO: 534 - DNA, 22 bp, Artificial sequence
  Synthetic
gcccagacaaaatcacctgttc

SEQ ID NO: 535 - DNA, 22 bp, Artificial sequence
  Synthetic
atacgcgtttattattattatc

SEQ ID NO: 536 - DNA, 22 bp, Artificial sequence
  Synthetic
gcacgcagtcatgctaacacac

SEQ ID NO: 537 - DNA, 19 bp, Artificial sequence
  Synthetic
tatagcaacaccttctgta

SEQ ID NO: 538 - DNA, 19 bp, Artificial sequence
  Synthetic
actaagcgctctcacttaa

SEQ ID NO: 539 - DNA, 19 bp, Artificial sequence
  Synthetic
gagcatccgttgatcttaa

SEQ ID NO: 540 - DNA, 19 bp, Artificial sequence
  Synthetic
ttctgtcttttcatgttca

SEQ ID NO: 541 - DNA, 21 bp, Artificial sequence
  Synthetic
tccaaggatatttaaaatctc

SEQ ID NO: 542 - DNA, 22 bp, Artificial sequence
  Synthetic
aaacaaacttaatcaagagtac

SEQ ID NO: 543 - DNA, 22 bp, Artificial sequence
  Synthetic
tatgcagaggctgaaagattac

SEQ ID NO: 544 - DNA, 22 bp, Artificial sequence
  Synthetic
acagtttattagtgtcatattc

SEQ ID NO: 545 - DNA, 19 bp, Artificial sequence
  Synthetic
agcgctgaagccaacatat

SEQ ID NO: 546 - DNA, 19 bp, Artificial sequence
  Synthetic
gtaaatgctggcatgctaa

SEQ ID NO: 547 - DNA, 19 bp, Artificial sequence
  Synthetic
tatgctctcatctaacata

SEQ ID NO: 548 - DNA, 19 bp, Artificial sequence
  Synthetic
gctgtaaactgcttggttt

SEQ ID NO: 549 - DNA, 22 bp, Artificial sequence
  Synthetic
gcagagggtaatttaagacatc

SEQ ID NO: 550 - DNA, 22 bp, Artificial sequence
  Synthetic
aaccactatgcagctacctcac

SEQ ID NO: 551 - DNA, 22 bp, Artificial sequence
  Synthetic
tcaggtagttacaattgaattc

SEQ ID NO: 552 - DNA, 22 bp, Artificial sequence
  Synthetic
caagtgagaaaatggtatattc

SEQ ID NO: 553 - DNA, 19 bp, Artificial sequence
  Synthetic
tgccgacacttgaatttat

SEQ ID NO: 554 - DNA, 19 bp, Artificial sequence
  Synthetic
gcaacagattgagtccttt

SEQ ID NO: 555 - DNA, 19 bp, Artificial sequence
  Synthetic
atgctgcagggtactttaa

SEQ ID NO: 556 - DNA, 19 bp, Artificial sequence
  Synthetic
ctacctcacttccagtcag

SEQ ID NO: 557 - DNA, 22 bp, Artificial sequence
  Synthetic
ccaggattttcatttcaggaac

SEQ ID NO: 558 - DNA, 22 bp, Artificial sequence
  Synthetic
taagattaatcttctctttgtc

SEQ ID NO: 559 - DNA, 22 bp, Artificial sequence
  Synthetic
ccttgttaatcgacttaatacc

SEQ ID NO: 560 - DNA, 22 bp, Artificial sequence
  Synthetic
tagggcagatcttcatgcaaac

SEQ ID NO: 561 - DNA, 19 bp, Artificial sequence
  Synthetic
acattctatgagaagcaat

SEQ ID NO: 562 - DNA, 19 bp, Artificial sequence
  Synthetic
agcaatggcactcattaat

SEQ ID NO: 563 - DNA, 19 bp, Artificial sequence
  Synthetic
atggctgtccactgcaatt

SEQ ID NO: 564 - DNA, 19 bp, Artificial sequence
  Synthetic
aatgtgggttgagtgtgat

SEQ ID NO: 565 - DNA, 22 bp, Artificial sequence
  Synthetic
cctggctaatcttttaaaaatc

SEQ ID NO: 566 - DNA, 22 bp, Artificial sequence
  Synthetic
ggccgatggtcctatttagatc

SEQ ID NO: 567 - DNA, 22 bp, Artificial sequence
  Synthetic
taacactatgcttatttactac

SEQ ID NO: 568 - DNA, 22 bp, Artificial sequence
  Synthetic
tctagattttatactttattac

SEQ ID NO: 569 - DNA, 22 bp, Artificial sequence
  Synthetic
agagctaaagctaaataggatc

SEQ ID NO: 570 - DNA, 19 bp, Artificial sequence
  Synthetic
gccactgtataactgtgtt

SEQ ID NO: 571 - DNA, 19 bp, Artificial sequence
  Synthetic
cctgactggtgaactatga

SEQ ID NO: 572 - DNA, 19 bp, Artificial sequence
  Synthetic
atgcctcactactttcaca

SEQ ID NO: 573 - DNA, 19 bp, Artificial sequence
  Synthetic
tcagaggaaaccctattta

SEQ ID NO: 574 - DNA, 22 bp, Artificial sequence
  Synthetic
gcagcttccaaattgacgacac

SEQ ID NO: 575 - DNA, 22 bp, Artificial sequence
  Synthetic
gcagggattaccctctgcactc

SEQ ID NO: 576 - DNA, 22 bp, Artificial sequence
  Synthetic
cctgagtggtaccaaacaaaac

SEQ ID NO: 577 - DNA, 22 bp, Artificial sequence
  Synthetic
aatctatgaactctaagtgaac

SEQ ID NO: 578 - DNA, 22 bp, Artificial sequence
  Synthetic
cctggactttactgcaactcac

SEQ ID NO: 579 - DNA, 19 bp, Artificial sequence
  Synthetic
tccagattcgacaagtgct

SEQ ID NO: 580 - DNA, 19 bp, Artificial sequence
  Synthetic
gacagatgtgccgtggatt

SEQ ID NO: 581 - DNA, 19 bp, Artificial sequence
  Synthetic
gatccctgttgtctctaga

SEQ ID NO: 582 - DNA, 19 bp, Artificial sequence
  Synthetic
ctggacttctgcaactcaa

SEQ ID NO: 583 - DNA, 22 bp, Artificial sequence
  Synthetic
ccacaaagttaagacttctgac

SEQ ID NO: 584 - DNA, 22 bp, Artificial sequence
  Synthetic
catcgtaaacctacttctaaac

SEQ ID NO: 585 - DNA, 22 bp, Artificial sequence
  Synthetic
tcccattttccttatttagaac

SEQ ID NO: 586 - DNA, 22 bp, Artificial sequence
  Synthetic
agcggatggtcaaacaatttac

SEQ ID NO: 587 - DNA, 19 bp, Artificial sequence
  Synthetic
cacaaagtagacttctgaa

SEQ ID NO: 588 - DNA, 19 bp, Artificial sequence
  Synthetic
acttctgagtggcactctt

SEQ ID NO: 589 - DNA, 19 bp, Artificial sequence
  Synthetic
gtgtacctgtcatctttct

SEQ ID NO: 590 - DNA, 19 bp, Artificial sequence
  Synthetic
gaactacacggatggttaa

SEQ ID NO: 591 - DNA, 22 bp, Artificial sequence
  Synthetic
ttacaaaaaactacaaaaattc

SEQ ID NO: 592 - DNA, 22 bp, Artificial sequence
  Synthetic
ttaggtgttaagagttaatacc

SEQ ID NO: 593 - DNA, 22 bp, Artificial sequence
  Synthetic
gcaagactctatctcaagatac

SEQ ID NO: 594 - DNA, 22 bp, Artificial sequence
  Synthetic
attaggttttctttttttttac

SEQ ID NO: 595 - DNA, 19 bp, Artificial sequence
  Synthetic
tcacttgatcagaagttca

SEQ ID NO: 596 - DNA, 19 bp, Artificial sequence
  Synthetic
catcgtgatgccgtcttta

SEQ ID NO: 597 - DNA, 19 bp, Artificial sequence
  Synthetic
gtgatggtgtgcatatatt

SEQ ID NO: 598 - DNA, 19 bp, Artificial sequence
  Synthetic
aggcagtgctgagattgca

SEQ ID NO: 599 - DNA, 22 bp, Artificial sequence
  Synthetic
gatggaacatactgtaactttc

SEQ ID NO: 600 - DNA, 22 bp, Artificial sequence
  Synthetic
ttgggatgtccttgttttcacc

SEQ ID NO: 601 - DNA, 22 bp, Artificial sequence
  Synthetic
gcacttttttctcctaatgtac

SEQ ID NO: 602 - DNA, 22 bp, Artificial sequence
  Synthetic
gacttcacttaatactatatgc

SEQ ID NO: 603 - DNA, 22 bp, Artificial sequence
  Synthetic
gcccggctaactttttgtattc

SEQ ID NO: 604 - DNA, 19 bp, Artificial sequence
  Synthetic
tggtttggtgtcattgttt

SEQ ID NO: 605 - DNA, 19 bp, Artificial sequence
  Synthetic
cgttgtcccttcacttgat

SEQ ID NO: 606 - DNA, 19 bp, Artificial sequence
  Synthetic
cagtaggagtgccacaatt

SEQ ID NO: 607 - DNA, 19 bp, Artificial sequence
  Synthetic
caatgattcaacttctaca

SEQ ID NO: 608 - DNA, 22 bp, Artificial sequence
  Synthetic
ttggatgaatcatattaatgtc

SEQ ID NO: 609 - DNA, 22 bp, Artificial sequence
  Synthetic
acagtttgtcattaggatgcac

SEQ ID NO: 610 - DNA, 22 bp, Artificial sequence
  Synthetic
tttggaagaacttggtattttc

SEQ ID NO: 611 - DNA, 22 bp, Artificial sequence
  Synthetic
aagggggtttcgttctcctaac

SEQ ID NO: 612 - DNA, 22 bp, Artificial sequence
  Synthetic
agaggtttttcgcactctttac

SEQ ID NO: 613 - DNA, 22 bp, Artificial sequence
  Synthetic
attggaaaaacattctaatgac

SEQ ID NO: 614 - DNA, 19 bp, Artificial sequence
  Synthetic
tgtccttaatgcaaatgaa

SEQ ID NO: 615 - DNA, 19 bp, Artificial sequence
  Synthetic
ccttgttgctgttggtaaa

SEQ ID NO: 616 - DNA, 19 bp, Artificial sequence
  Synthetic
tgtgcatactgcagcattt

SEQ ID NO: 617 - DNA, 19 bp, Artificial sequence
  Synthetic
gttgtgcaattgcattcat

SEQ ID NO: 618 - DNA, 22 bp, Artificial sequence
  Synthetic
taaagaaggacctccaaagttc

SEQ ID NO: 619 - DNA, 22 bp, Artificial sequence
  Synthetic
aaacacttatcttgtttcttac

SEQ ID NO: 620 - DNA, 22 bp, Artificial sequence
  Synthetic
aaaggccatacatatatatatc

SEQ ID NO: 621 - DNA, 22 bp, Artificial sequence
  Synthetic
gtaggaagtgacttgtacatac

SEQ ID NO: 622 - DNA, 22 bp, Artificial sequence
  Synthetic
gcaaagctctatcgacagcaac

SEQ ID NO: 623 - DNA, 19 bp, Artificial sequence
  Synthetic
acctctggttaaagaagga

SEQ ID NO: 624 - DNA, 19 bp, Artificial sequence
  Synthetic
gttactgatctcagggcat

SEQ ID NO: 625 - DNA, 19 bp, Artificial sequence
  Synthetic
taggaagtcttgtacataa

SEQ ID NO: 626 - DNA, 19 bp, Artificial sequence
  Synthetic
ctctgcaactctctcgaca

SEQ ID NO: 627 - DNA, 22 bp, Artificial sequence
  Synthetic
catgttagtgattgggtcttac

SEQ ID NO: 628 - DNA, 22 bp, Artificial sequence
  Synthetic
attggaaagaattgtagggaac

SEQ ID NO: 629 - DNA, 22 bp, Artificial sequence
  Synthetic
ctgggctcaaaaggatgtcaac

SEQ ID NO: 630 - DNA, 22 bp, Artificial sequence
  Synthetic
tttgagaattcttactttagac

SEQ ID NO: 631 - DNA, 19 bp, Artificial sequence
  Synthetic
gatcagcattgacatcatt

SEQ ID NO: 632 - DNA, 19 bp, Artificial sequence
  Synthetic
gggtcttaggtccatagga

SEQ ID NO: 633 - DNA, 19 bp, Artificial sequence
  Synthetic
gaactcaactggcaagaaa

SEQ ID NO: 634 - DNA, 19 bp, Artificial sequence
  Synthetic
ccaacagaatgcatccata

SEQ ID NO: 635 - DNA, 22 bp, Artificial sequence
  Synthetic
tggagaagaccgtggcgaccac

SEQ ID NO: 636 - DNA, 22 bp, Artificial sequence
  Synthetic
caagacgattctctgccttagc

SEQ ID NO: 637 - DNA, 22 bp, Artificial sequence
  Synthetic
tccgcaggctaagagcaagatc

SEQ ID NO: 638 - DNA, 22 bp, Artificial sequence
  Synthetic
gccggagcagatctgacctggc

SEQ ID NO: 639 - DNA, 19 bp, Artificial sequence
  Synthetic
gtacttcagagctgtctag

SEQ ID NO: 640 - DNA, 19 bp, Artificial sequence
  Synthetic
gagcctttctttcaccttt

SEQ ID NO: 641 - DNA, 19 bp, Artificial sequence
  Synthetic
atagaggatggagcaagaa

SEQ ID NO: 642 - DNA, 19 bp, Artificial sequence
  Synthetic
ccacctccctgtttctcat

SEQ ID NO: 643 - DNA, 22 bp, Artificial sequence
  Synthetic
cctcctgctgcttctcatcctc

SEQ ID NO: 644 - DNA, 22 bp, Artificial sequence
  Synthetic
gaggcatcttatggaagatacc

SEQ ID NO: 645 - DNA, 22 bp, Artificial sequence
  Synthetic
tttgctattacagatgaatatc

SEQ ID NO: 646 - DNA, 22 bp, Artificial sequence
  Synthetic
tgcgtgtgtgcgtgtgtgtgtc

SEQ ID NO: 647 - DNA, 19 bp, Artificial sequence
  Synthetic
catcttctaagatacactt

SEQ ID NO: 648 - DNA, 19 bp, Artificial sequence
  Synthetic
caaaggcattataagtaag

SEQ ID NO: 649 - DNA, 19 bp, Artificial sequence
  Synthetic
ccctcaagcttacagttaa

SEQ ID NO: 650 - DNA, 19 bp, Artificial sequence
  Synthetic
aggcatcttggaagataca

SEQ ID NO: 651 - DNA, 22 bp, Artificial sequence
  Synthetic
catgatcttccttataattctc

SEQ ID NO: 652 - DNA, 22 bp, Artificial sequence
  Synthetic
caaagcttgtcaagatagttac

SEQ ID NO: 653 - DNA, 22 bp, Artificial sequence
  Synthetic
attggaaattcgttataatgac

SEQ ID NO: 654 - DNA, 22 bp, Artificial sequence
  Synthetic
taagattcatctttacttcttc

SEQ ID NO: 655 - DNA, 19 bp, Artificial sequence
  Synthetic
tttgaagaccgcatttgga

SEQ ID NO: 656 - DNA, 19 bp, Artificial sequence
  Synthetic
tgagtgctctccatgtttg

SEQ ID NO: 657 - DNA, 19 bp, Artificial sequence
  Synthetic
tctaggagctggcaactta

SEQ ID NO: 658 - DNA, 19 bp, Artificial sequence
  Synthetic
gtaaggcagttgtggttaa

SEQ ID NO: 659 - DNA, 22 bp, Artificial sequence
  Synthetic
acccgaatttctgattaagatc

SEQ ID NO: 660 - DNA, 22 bp, Artificial sequence
  Synthetic
tcccacagataatggatcttcc

SEQ ID NO: 661 - DNA, 22 bp, Artificial sequence
  Synthetic
ttgggctctaagtcctggagac

SEQ ID NO: 662 - DNA, 22 bp, Artificial sequence
  Synthetic
taatagtgttaataaagaaatc

SEQ ID NO: 663 - DNA, 19 bp, Artificial sequence
  Synthetic
gctgaagatgccaaacact

SEQ ID NO: 664 - DNA, 19 bp, Artificial sequence
  Synthetic
ctctaggttggagaatgtt

SEQ ID NO: 665 - DNA, 19 bp, Artificial sequence
  Synthetic
tgtgtctgcgtgttgtatg

SEQ ID NO: 666 - DNA, 19 bp, Artificial sequence
  Synthetic
gttgtatgctgctgccgat

SEQ ID NO: 667 - DNA, 22 bp, Artificial sequence
  Synthetic
gaagtggagtcaggagcttctc

SEQ ID NO: 668 - DNA, 22 bp, Artificial sequence
  Synthetic
acccgtcatgattcaatacacc

SEQ ID NO: 669 - DNA, 22 bp, Artificial sequence
  Synthetic
catcccaataaatatccccctc

SEQ ID NO: 670 - DNA, 22 bp, Artificial sequence
  Synthetic
ttagcatgcataagtgactaca

SEQ ID NO: 671 - DNA, 19 bp, Artificial sequence
  Synthetic
gaagtggataggagcttct

SEQ ID NO: 672 - DNA, 19 bp, Artificial sequence
  Synthetic
ctaacccgatggttcaata

SEQ ID NO: 673 - DNA, 19 bp, Artificial sequence
  Synthetic
tctctgcaccaatagatat

SEQ ID NO: 674 - DNA, 19 bp, Artificial sequence
  Synthetic
cttagcatctaagtgacta

SEQ ID NO: 675 - DNA, 22 bp, Artificial sequence
  Synthetic
ccagaggctaactccaaaaccc

SEQ ID NO: 676 - DNA, 22 bp, Artificial sequence
  Synthetic
gctcccaatccgtgttcctaac

SEQ ID NO: 677 - DNA, 22 bp, Artificial sequence
  Synthetic
tctgcttctcctctcctacttc

SEQ ID NO: 678 - DNA, 22 bp, Artificial sequence
  Synthetic
cccccaagtaagaaataggctc

SEQ ID NO: 679 - DNA, 19 bp, Artificial sequence
  Synthetic
ccaggtcacttcatcctca

SEQ ID NO: 680 - DNA, 19 bp, Artificial sequence
  Synthetic
tctcctgtctgctcccaat

SEQ ID NO: 681 - DNA, 19 bp, Artificial sequence
  Synthetic
gattctcactgcttctcat

SEQ ID NO: 682 - DNA, 19 bp, Artificial sequence
  Synthetic
agtacgaaaggctaaacca

SEQ ID NO: 683 - DNA, 15 bp, Artificial sequence
  Synthetic
gtgaagccacagatg

SEQ ID NO: 684 - DNA, 15 bp, Artificial sequence
  Synthetic
tttggccactgactg

SEQ ID NO: 685 - DNA, 19 bp, Artificial sequence
  Synthetic
gttttggccactgactgac

SEQ ID NO: 686 - DNA, 13 bp, Artificial sequence
  Synthetic
ctgggctcagacc

SEQ ID NO: 687 - DNA, 16 bp, Artificial sequence
  Synthetic
ctgttgaatctcatgg

SEQ ID NO: 688 - DNA, 19 bp, Artificial sequence
  Synthetic
ctgtgaagccacagatggg

SEQ ID NO: 689 - DNA, 13 bp, Artificial sequence
  Synthetic
tgtttagttatct

SEQ ID NO: 690 - DNA, 20 bp, Artificial sequence
  Synthetic
ttaagattctaaaattatct

SEQ ID NO: 691 - DNA, 14 bp, Artificial sequence
  Synthetic
tgtctaaactatca

SEQ ID NO: 692 - DNA, 13 bp, Artificial sequence
  Synthetic
tggtcccctcccc

SEQ ID NO: 693 - DNA, 47 bp, Artificial sequence
  Synthetic
atctgatcttctgaagaaaatatatttctttttattcatagctctta

SEQ ID NO: 694 - DNA, 133 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctg

SEQ ID NO: 695 - DNA, 41 bp, Artificial sequence
  Synthetic
tcagttttattgatagtcttttcagtattattgataatctt

SEQ ID NO: 696 - DNA, 95 bp, Artificial sequence
  Synthetic
accgtgggaggatgacaagtccaagagtcaccctgctggatgaacgtagatgtcagactctatcatttaatgtgctagtcataacctggttacta

SEQ ID NO: 697 - DNA, 25 bp, Artificial sequence
  Synthetic
ggtgatagcaatgtcagcagtgcct

SEQ ID NO: 698 - DNA, 23 bp, Artificial sequence
  Synthetic
aagtaaggttgaccatactctac

SEQ ID NO: 699 - DNA, 28 bp, Artificial sequence
  Synthetic
ctggaggcttgctgaaggctgtatgctg

SEQ ID NO: 700 - DNA, 30 bp, Artificial sequence
  Synthetic
caggacacaaggcctgttactagcactcac

SEQ ID NO: 701 - DNA, 15 bp, Artificial sequence
  Synthetic
ctccccatggccctg

SEQ ID NO: 702 - DNA, 12 bp, Artificial sequence
  Synthetic
ggacctggggac

SEQ ID NO: 703 - DNA, 19 bp, Artificial sequence
  Synthetic
gctgtaccaccttgtcggg

SEQ ID NO: 704 - DNA, 20 bp, Artificial sequence
  Synthetic
ctgacattttggtatctttc

SEQ ID NO: 705 - DNA, 20 bp, Artificial sequence
  Synthetic
tgctgttgacagtgagcgac

SEQ ID NO: 706 - DNA, 15 bp, Artificial sequence
  Synthetic
tgcctactgcctcgg

SEQ ID NO: 707 - DNA, 2248 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctccaaaaaagaagagaaaggtagaagatcccaaggactttccttcagaattgctaagttttttgagtcatgctgtgtttagtaatagaactcttgcttgctttgctatttacaccacaaaggaaaaagctgcactgctatacaagaaaattatggaaaaatattctgtaacctttataagtaggcataacagttataatcataacatactgttttttcttactccacacaggcatagagtgtctgctattaataactatgctcaaaaattgtgtacctttagctttttaatttgtaaaggggttaataaggaatatttgatgtatagtgccttgactagagatcataatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctg

SEQ ID NO: 708 - DNA, 1945 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggtggcatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgataattagactttgagtgatcttgagcctttcctagttcatcccaccccgccccagagagatctttgtgaaggaaccttacttctgtggtgtgacataattggacaaactacctacagagatttaaagctctaaggtaaatataaaatttttaagtgtataatgtgttaaactactgattctaattgtttgtgtattttagattccaacctatggaactgatgaatgggagcagtggtggaatgcctttaatgaggaaaacctgttttgctcagaagaaatgccatctagtgatgatgaggctactgctgactctcaacattctactcctctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 709 - DNA, 13 bp, Artificial sequence
  Synthetic
gtcagcagtgcct

SEQ ID NO: 710 - DNA, 11 bp, Artificial sequence
  Synthetic
gtaaggttgac

SEQ ID NO: 711 - DNA, 14 bp, Artificial sequence
  Synthetic
ccttagcagagctg

SEQ ID NO: 712 - DNA, 13 bp, Artificial sequence
  Synthetic
gctactgctaggc

SEQ ID NO: 713 - DNA, 14 bp, Artificial sequence
  Synthetic
agggggcgagggat

SEQ ID NO: 714 - DNA, 11 bp, Artificial sequence
  Synthetic
cttccctccca

SEQ ID NO: 715 - DNA, 21 bp, Artificial sequence
  Synthetic
atggaacaaatggcccagatc

SEQ ID NO: 716 - DNA, 42 bp, Artificial sequence
  Synthetic
ttatattctttaggcacgaatgtgtgtttaaaaaaaataaaa

SEQ ID NO: 717 - DNA, 39 bp, Artificial sequence
  Synthetic
agttgtgttttaatgtatattaatgttactaatgtgttt

SEQ ID NO: 718 - DNA, 40 bp, Artificial sequence
  Synthetic
gttatttttagtatgattctgtaaaaatgaattaatacta

SEQ ID NO: 719 - DNA, 40 bp, Artificial sequence
  Synthetic
atttttcagatgtatcatctcttaaaatactgtaattgca

SEQ ID NO: 720 - DNA, 38 bp, Artificial sequence
  Synthetic
aagcttatgcagcattagaggaatttattttaatgcac

SEQ ID NO: 721 - DNA, 40 bp, Artificial sequence
  Synthetic
atttatattcaacatagacattaattcagatttttacttg

SEQ ID NO: 722 - DNA, 40 bp, Artificial sequence
  Synthetic
ggataaaacaaattctagttttccctttgttttgaaatta

SEQ ID NO: 723 - DNA, 714 bp, Artificial sequence
  Synthetic
atggtgtcaaaaggggaggaattgatcaaagagaacatgcatatgaaactgtacatggagggaactgtcaacaatcaccacttcaaatgcacctcagagggcgagggaaagccctacgaagggacccagaccatgcgcattaaggtggtcgaaggcggaccactcccttttgcattcgacatcctggctacctccttcatgtacggatcgcgcacttttatcaagtacccgaaggggatcccggacttcttcaagcaatccttccctgagggattcacttgggaacgggtcacgacctacgaagatggaggcgtggtgaccgtgatgcaagacactagcctggaagatggctgccttgtctacaacgtgaagatcagaggtgtgaacttcccatccaatggccccgtgatgcagaaaaagactctggggtgggaagccaataccgaaatgctctacccagcggacggaggactcgaaggccggtctgacatggccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaa

SEQ ID NO: 724 - DNA, 708 bp, Artificial sequence
  Synthetic
gtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaat

SEQ ID NO: 725 - DNA, 442 bp, Artificial sequence
  Synthetic
atctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagactagtggtgatagcaatgtcagcagtgcctttaaattacataatgtggcagtgtgaagccacagatgactgccacatcatgtaatttacaagtaaggttgaccatactctactctagactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatctt

SEQ ID NO: 726 - DNA, 523 bp, Artificial sequence
  Synthetic
atctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatctt

SEQ ID NO: 727 - DNA, 681 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtgaatctgttgattgcagtgagttttggccactgactgactcactgcacaacagattcacaggacacaaggcctgttactagcactcacatggaacaaatggcccagatcctggaggcttgctgaaggctgtatgctgctgagatggtctgaactaaatgttttggccactgactgacatttagttgaccatctcagcaggacacaaggcctgttactagcactcacatggaacaaatggcccagatcctggaggcttgctgaaggctgtatgctgagatataggcaccatgtttgagttttggccactgactgactcaaacattgcctatatctcaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 728 - DNA, 405 bp, Artificial sequence
  Synthetic
atctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgttttcagttttattgatagtcttttcagtattattgataatctt

SEQ ID NO: 729 - DNA, 245 bp, Artificial sequence
  Synthetic
atctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagagttgtgttttaatgtatattaatgttactaatgtgttttcagttttattgatagtcttttcagtattattgataatctt

SEQ ID NO: 730 - DNA, 957 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttaccaggaaagaccctggctgttttggccactgactgacagccagggtttcctggtaacaggacacaaggcctgttactagcactcacatggaacaaatggcccagatcctggaggcttgctgaaggctgtatgctgaaacctgtggcccagctcttagttttggccactgactgactaagagctgccacaggtttcaggacacaaggcctgttactagcactcacatggaacaaatggcccagatcctggaggcttgctgaaggctgtatgctgaaatcattcagaggagcctttgttttggccactgactgacaaaggctcctgaatgatttcaggacacaaggcctgttactagcactcacatggaacaaatggcccagatcctggaggcttgctgaaggctgtatgctgtgtagaagacatcacttcatcgttttggccactgactgacgatgaagttgtcttctacacaggacacaaggcctgttactagcactcacatggaacaaatggcccagatcctggaggcttgctgaaggctgtatgctgtgaatctgttgattgcagtgagttttggccactgactgactcactgcacaacagattcacaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 731 - DNA, 839 bp, Artificial sequence
  Synthetic
atctgatcttctgaagaaaatatatttctttttattcatagctcttaactagtggtgatagcaatgtcagcagtgcctttaaacttcttgatttcccaaagtgaagccacagatgtttgggaaataaagaagtttacaagtaaggttgaccatactctactctagttatattctttaggcacgaatgtgtgtttaaaaaaaataaaaactagtggtgatagcaatgtcagcagtgccttcctcttagatcatattccaaggtgaagccacagatgcttggaatataatctaagaggcaagtaaggttgaccatactctactctagagttgtgttttaatgtatattaatgttactaatgtgtttactagtggtgatagcaatgtcagcagtgcctttcaagtaaaatgagtatgtgagtgaagccacagatgtcacatactccttttacttgacaagtaaggttgaccatactctactctaggttatttttagtatgattctgtaaaaatgaattaatactaactagtggtgatagcaatgtcagcagtgccttcaattagtgggatcacaacccgtgaagccacagatggggttgtgataccactaattgcatttttcagatgtatcatctcttaaaatactgtaattgcaactagtggtgatagcaatgtcagcagtgcctttaaattacataatgtggcagtgtgaagccacagatgactgccacatcatgtaatttacaagtaaggttgaccatactctactctagaagtaaggttgaccatactctactctagtcagttttattgatagtcttttcagtattattgataatctt

SEQ ID NO: 732 - DNA, 681 bp, Artificial sequence
  Synthetic
atctgatcttctgaagaaaatatatttctttttattcatagctcttaactagtggtgatagcaatgtcagcagtgcctttaaacttcttgatttcccaaagtgaagccacagatgtttgggaaataaagaagtttacaagtaaggttgaccatactctactctagttatattctttaggcacgaatgtgtgtttaaaaaaaataaaaactagtggtgatagcaatgtcagcagtgccttcctcttagatcatattccaaggtgaagccacagatgcttggaatataatctaagaggcaagtaaggttgaccatactctactctagagttgtgttttaatgtatattaatgttactaatgtgtttactagtggtgatagcaatgtcagcagtgcctttcaagtaaaatgagtatgtgagtgaagccacagatgtcacatactccttttacttgacaagtaaggttgaccatactctactctaggttatttttagtatgattctgtaaaaatgaattaatactaactagtggtgatagcaatgtcagcagtgccttcaattagtgggatcacaacccgtgaagccacagatggggttgtgataccactaattgcaagtaaggttgaccatactctactctagtcagttttattgatagtcttttcagtattattgataatctt

SEQ ID NO: 733 - DNA, 774 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttaccaggaaagaccctggctgttttggccactgactgacagccagggtttcctggtaacaggacacaaggcctgttactagcactcacatggaacaaatggcccagatcctggaggcttgctgaaggctgtatgctgaaacctgtggcccagctcttagttttggccactgactgactaagagctgccacaggtttcaggacacaaggcctgttactagcactcacatggaacaaatggcccagatcctggaggcttgctgaaggctgtatgctgaaatcattcagaggagcctttgttttggccactgactgacaaaggctcctgaatgatttcaggacacaaggcctgttactagcactcacatggaacaaatggcccagatcctggaggcttgctgaaggctgtatgctgtgtagaagacatcacttcatcgttttggccactgactgacgatgaagttgtcttctacacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 734 - DNA, 521 bp, Artificial sequence
  Synthetic
atctgatcttctgaagaaaatatatttctttttattcatagctcttaactagtggtgatagcaatgtcagcagtgcctttggtcgtttatctcttccatcgtgaagccacagatggatggaagagctaaacgaccacaagtaaggttgaccatactctactctagagttgtgttttaatgtatattaatgttactaatgtgtttactagtggtgatagcaatgtcagcagtgcctttcatctacagtttggctgaaagtgaagccacagatgtttcagccaacctgtagatgacaagtaaggttgaccatactctactctaggttatttttagtatgattctgtaaaaatgaattaatactaactagtggtgatagcaatgtcagcagtgcctttaaattacacaatatggcagtgtgaagccacagatgactgccatatcgtgtaatttacaagtaaggttgaccatactctactctagtcagttttattgatagtcttttcagtattattgataatctt

SEQ ID NO: 735 - DNA, 839 bp, Artificial sequence
  Synthetic
atctgatcttctgaagaaaatatatttctttttattcatagctcttaactagtggtgatagcaatgtcagcagtgccttaaaacatcttgatttcacaaagtgaagccacagatgtttgtgaaataaagatgttttcaagtaaggttgaccatactctactctagttatattctttaggcacgaatgtgtgtttaaaaaaaataaaaactagtggtgatagcaatgtcagcagtgccttattacttgtaaacactggttcgtgaagccacagatggaaccagtgtctacaagtaatcaagtaaggttgaccatactctactctagagttgtgttttaatgtatattaatgttactaatgtgtttactagtggtgatagcaatgtcagcagtgcctttcatctacagtttggctgaaagtgaagccacagatgtttcagccaacctgtagatgacaagtaaggttgaccatactctactctaggttatttttagtatgattctgtaaaaatgaattaatactaactagtggtgatagcaatgtcagcagtgcctttgttgtgtaacaacataatttgtgaagccacagatgaaattatgttattacacaacacatttttcagatgtatcatctcttaaaatactgtaattgcaactagtggtgatagcaatgtcagcagtgcctttcactactgtgctggccccgcgtgaagccacagatggcggggccagaacagtagtgacaagtaaggttgaccatactctactctagaagtaaggttgaccatactctactctagtcagttttattgatagtcttttcagtattattgataatctt

SEQ ID NO: 736 - DNA, 681 bp, Artificial sequence
  Synthetic
atctgatcttctgaagaaaatatatttctttttattcatagctcttaactagtggtgatagcaatgtcagcagtgccttaaaacatcttgatttcacaaagtgaagccacagatgtttgtgaaataaagatgttttcaagtaaggttgaccatactctactctagttatattctttaggcacgaatgtgtgtttaaaaaaaataaaaactagtggtgatagcaatgtcagcagtgccttattacttgtaaacactggttcgtgaagccacagatggaaccagtgtctacaagtaatcaagtaaggttgaccatactctactctagagttgtgttttaatgtatattaatgttactaatgtgtttactagtggtgatagcaatgtcagcagtgcctttcactactgtgctggccccgcgtgaagccacagatggcggggccagaacagtagtgacaagtaaggttgaccatactctactctaggttatttttagtatgattctgtaaaaatgaattaatactaactagtggtgatagcaatgtcagcagtgcctttgttgtgtaacaacataatttgtgaagccacagatgaaattatgttattacacaacacaagtaaggttgaccatactctactctagtcagttttattgatagtcttttcagtattattgataatctt

SEQ ID NO: 737 - DNA, 521 bp, Artificial sequence
  Synthetic
atctgatcttctgaagaaaatatatttctttttattcatagctcttaactagtggtgatagcaatgtcagcagtgccttgaatcatcatgatagccgcttgtgaagccacagatgaagcggctataatgatgattccaagtaaggttgaccatactctactctagagttgtgttttaatgtatattaatgttactaatgtgtttactagtggtgatagcaatgtcagcagtgccttcttgtgtgttcattatcctaggtgaagccacagatgctaggataataaacacacaagcaagtaaggttgaccatactctactctaggttatttttagtatgattctgtaaaaatgaattaatactaactagtggtgatagcaatgtcagcagtgccttatttcttcacaatgagcactcgtgaagccacagatggagtgctcatcgtgaagaaatcaagtaaggttgaccatactctactctagtcagttttattgatagtcttttcagtattattgataatctt

SEQ ID NO: 738 - DNA, 681 bp, Artificial sequence
  Synthetic
atctgatcttctgaagaaaatatatttctttttattcatagctcttaactagtggtgatagcaatgtcagcagtgccttcatccatagaaaactcctcgggtgaagccacagatgccgaggagttctctatggatgcaagtaaggttgaccatactctactctagttatattctttaggcacgaatgtgtgtttaaaaaaaataaaaactagtggtgatagcaatgtcagcagtgccttgaatcatcatgatagccgcttgtgaagccacagatgaagcggctataatgatgattccaagtaaggttgaccatactctactctagagttgtgttttaatgtatattaatgttactaatgtgtttactagtggtgatagcaatgtcagcagtgccttcttgtgtgttcattatcctaggtgaagccacagatgctaggataataaacacacaagcaagtaaggttgaccatactctactctaggttatttttagtatgattctgtaaaaatgaattaatactaactagtggtgatagcaatgtcagcagtgccttatttcttcacaatgagcactcgtgaagccacagatggagtgctcatcgtgaagaaatcaagtaaggttgaccatactctactctagtcagttttattgatagtcttttcagtattattgataatctt

SEQ ID NO: 739 - DNA, 839 bp, Artificial sequence
  Synthetic
atctgatcttctgaagaaaatatatttctttttattcatagctcttaactagtggtgatagcaatgtcagcagtgccttcatccatagaaaactcctcgggtgaagccacagatgccgaggagttctctatggatgcaagtaaggttgaccatactctactctagttatattctttaggcacgaatgtgtgtttaaaaaaaataaaaactagtggtgatagcaatgtcagcagtgccttgaatcatcatgatagccgcttgtgaagccacagatgaagcggctataatgatgattccaagtaaggttgaccatactctactctagagttgtgttttaatgtatattaatgttactaatgtgtttactagtggtgatagcaatgtcagcagtgccttcttgtgtgttcattatcctaggtgaagccacagatgctaggataataaacacacaagcaagtaaggttgaccatactctactctaggttatttttagtatgattctgtaaaaatgaattaatactaactagtggtgatagcaatgtcagcagtgccttatttcttcacaatgagcactcgtgaagccacagatggagtgctcatcgtgaagaaatcatttttcagatgtatcatctcttaaaatactgtaattgcaactagtggtgatagcaatgtcagcagtgccttgttttcagtgtatccatgagggtgaagccacagatgcctcatggatccactgaaaaccaagtaaggttgaccatactctactctagaagtaaggttgaccatactctactctagtcagttttattgatagtcttttcagtattattgataatctt

SEQ ID NO: 740 - DNA, 521 bp, Artificial sequence
  Synthetic
atctgatcttctgaagaaaatatatttctttttattcatagctcttaactagtggtgatagcaatgtcagcagtgcctttttacttggtgtttatgcagggtgaagccacagatgcctgcataaaaaccaagtaaacaagtaaggttgaccatactctactctagagttgtgttttaatgtatattaatgttactaatgtgtttactagtggtgatagcaatgtcagcagtgccttacaacatctactagatggcttgtgaagccacagatgaagccatctaatagatgttgtcaagtaaggttgaccatactctactctaggttatttttagtatgattctgtaaaaatgaattaatactaactagtggtgatagcaatgtcagcagtgccttttatgtcagagtctgactggtgtgaagccacagatgaccagtcagaatctgacataacaagtaaggttgaccatactctactctagtcagttttattgatagtcttttcagtattattgataatctt

SEQ ID NO: 741 - DNA, 521 bp, Artificial sequence
  Synthetic
atctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatctt

SEQ ID NO: 742 - DNA, 521 bp, Artificial sequence
  Synthetic
atctgatcttctgaagaaaatatatttctttttattcatagctcttaactagtggtgatagcaatgtcagcagtgccttaactcatagatctaaagccaagtgaagccacagatgttggctttagctctatgagttcaagtaaggttgaccatactctactctagagttgtgttttaatgtatattaatgttactaatgtgtttactagtggtgatagcaatgtcagcagtgccttagagtacaacagttgcccagggtgaagccacagatgcctgggcaaccgttgtactctcaagtaaggttgaccatactctactctaggttatttttagtatgattctgtaaaaatgaattaatactaactagtggtgatagcaatgtcagcagtgcctttgtttagaattatacaggggcgtgaagccacagatggcccctgtatcattctaaacacaagtaaggttgaccatactctactctagtcagttttattgatagtcttttcagtattattgataatctt

SEQ ID NO: 743 - DNA, 363 bp, Artificial sequence
  Synthetic
atctgatcttctgaagaaaatatatttctttttattcatagctcttaactagtggtgatagcaatgtcagcagtgccttgactgtacaaagcaatccatggtgaagccacagatgcatggattgccttgtacagtccaagtaaggttgaccatactctactctagagttgtgttttaatgtatattaatgttactaatgtgtttactagtggtgatagcaatgtcagcagtgccttagtttcatataaacacccattgtgaagccacagatgaatgggtgttcatatgaaactcaagtaaggttgaccatactctactctagtcagttttattgatagtcttttcagtattattgataatctt

SEQ ID NO: 744 - DNA, 363 bp, Artificial sequence
  Synthetic
atctgatcttctgaagaaaatatatttctttttattcatagctcttaactagtggtgatagcaatgtcagcagtgccttgtattttctaataaaatggaggtgaagccacagatgctccattttactagaaaataccaagtaaggttgaccatactctactctagagttgtgttttaatgtatattaatgttactaatgtgtttactagtggtgatagcaatgtcagcagtgccttttagctacaaaaacattcacagtgaagccacagatgtgtgaatgttcttgtagctaacaagtaaggttgaccatactctactctagtcagttttattgatagtcttttcagtattattgataatctt

SEQ ID NO: 745 - DNA, 363 bp, Artificial sequence
  Synthetic
atctgatcttctgaagaaaatatatttctttttattcatagctcttaactagtggtgatagcaatgtcagcagtgcctaagaagaaaaacaatgtccatagtgaagccacagatgtatggacattatttttcttctcaagtaaggttgaccatactctactctagagttgtgttttaatgtatattaatgttactaatgtgtttactagtggtgatagcaatgtcagcagtgccttattgtgaaatcaataaactgggtgaagccacagatgccagtttattaatttcacaatcaagtaaggttgaccatactctactctagtcagttttattgatagtcttttcagtattattgataatctt

SEQ ID NO: 746 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgaaacacttccctgaattcctcgttttggccactgactgacgaggaattgggaagtgtttcaggacacaaggcctgttactagcactcacatggaacaaatggcccagatcctggaggcttgctgaaggctgtatgctgttgctaaggcagttactagaggttttggccactgactgacctctagtatgccttagcaacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 747 - DNA, 363 bp, Artificial sequence
  Synthetic
atctgatcttctgaagaaaatatatttctttttattcatagctcttaactagtggtgatagcaatgtcagcagtgccttgtgtcactgctctctccgatggtgaagccacagatgcatcggagagcgcagtgacaccaagtaaggttgaccatactctactctagagttgtgttttaatgtatattaatgttactaatgtgtttactagtggtgatagcaatgtcagcagtgcctttgaggaagagactcagcccccgtgaagccacagatggggggctgagcctcttcctcacaagtaaggttgaccatactctactctagtcagttttattgatagtcttttcagtattattgataatctt

SEQ ID NO: 748 - DNA, 363 bp, Artificial sequence
  Synthetic
atctgatcttctgaagaaaatatatttctttttattcatagctcttaactagtggtgatagcaatgtcagcagtgccttgtgtcactgctctctccgatggtgaagccacagatgcatcggagagcgcagtgacaccaagtaaggttgaccatactctactctagagttgtgttttaatgtatattaatgttactaatgtgtttactagtggtgatagcaatgtcagcagtgccttagtcaactacttacacggaacgtgaagccacagatggttccgtgtacgtagttgactcaagtaaggttgaccatactctactctagtcagttttattgatagtcttttcagtattattgataatctt

SEQ ID NO: 749 - DNA, 363 bp, Artificial sequence
  Synthetic
atctgatcttctgaagaaaatatatttctttttattcatagctcttaactagtggtgatagcaatgtcagcagtgccttcaggctctgagcagtgccttcgtgaagccacagatggaaggcactgctcagagcctgaaagtaaggttgaccatactctactctagagttgtgttttaatgtatattaatgttactaatgtgtttactagtggtgatagcaatgtcagcagtgccttgtgtcactgctctctccgatggtgaagccacagatgcatcggagagcgcagtgacaccaagtaaggttgaccatactctactctagtcagttttattgatagtcttttcagtattattgataatctt

SEQ ID NO: 750 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgatgggtgtgtcactgctctctgttttggccactgactgacagagagcagacacacccatcaggacacaaggcctgttactagcactcacatggaacaaatggcccagatcctggaggcttgctgaaggctgtatgctgaaccgatgtgcacatctatgcgttttggccactgactgacgcatagatgcacatcggttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 751 - DNA, 681 bp, Artificial sequence
  Synthetic
atctgatcttctgaagaaaatatatttctttttattcatagctcttaactagtggtgatagcaatgtcagcagtgcctaagaagaaaaacaatgtccatagtgaagccacagatgtatggacattatttttcttctcaagtaaggttgaccatactctactctagttatattctttaggcacgaatgtgtgtttaaaaaaaataaaaactagtggtgatagcaatgtcagcagtgccttgtgtcactgctctctccgatggtgaagccacagatgcatcggagagcgcagtgacaccaagtaaggttgaccatactctactctagagttgtgttttaatgtatattaatgttactaatgtgtttactagtggtgatagcaatgtcagcagtgcctaaatccaggacttttatccgaggtgaagccacagatgctcggataaacgtcctggattcaagtaaggttgaccatactctactctaggttatttttagtatgattctgtaaaaatgaattaatactaactagtggtgatagcaatgtcagcagtgcctttaccctggagcaagcaggtcagtgaagccacagatgtgacctgcttactccagggtacaagtaaggttgaccatactctactctagtcagttttattgatagtcttttcagtattattgataatctt

SEQ ID NO: 752 - DNA, 681 bp, Artificial sequence
  Synthetic
atctgatcttctgaagaaaatatatttctttttattcatagctcttaactagtggtgatagcaatgtcagcagtgccttgactgtacaaagcaatccatggtgaagccacagatgcatggattgccttgtacagtccaagtaaggttgaccatactctactctagttatattctttaggcacgaatgtgtgtttaaaaaaaataaaaactagtggtgatagcaatgtcagcagtgccttgtattttctaataaaatggaggtgaagccacagatgctccattttactagaaaataccaagtaaggttgaccatactctactctagagttgtgttttaatgtatattaatgttactaatgtgtttactagtggtgatagcaatgtcagcagtgcctttgaggaagagactcagcccccgtgaagccacagatggggggctgagcctcttcctcacaagtaaggttgaccatactctactctaggttatttttagtatgattctgtaaaaatgaattaatactaactagtggtgatagcaatgtcagcagtgccttagtcaactacttacacggaacgtgaagccacagatggttccgtgtacgtagttgactcaagtaaggttgaccatactctactctagtcagttttattgatagtcttttcagtattattgataatctt

SEQ ID NO: 753 - DNA, 681 bp, Artificial sequence
  Synthetic
atctgatcttctgaagaaaatatatttctttttattcatagctcttaactagtggtgatagcaatgtcagcagtgccttagtcaactacttacacggaacgtgaagccacagatggttccgtgtacgtagttgactcaagtaaggttgaccatactctactctagttatattctttaggcacgaatgtgtgtttaaaaaaaataaaaactagtggtgatagcaatgtcagcagtgccttagtttcatataaacacccattgtgaagccacagatgaatgggtgttcatatgaaactcaagtaaggttgaccatactctactctagagttgtgttttaatgtatattaatgttactaatgtgtttactagtggtgatagcaatgtcagcagtgcctttaccttaaaggaaactactttgtgaagccacagatgaaagtagtttactttaaggtacaagtaaggttgaccatactctactctaggttatttttagtatgattctgtaaaaatgaattaatactaactagtggtgatagcaatgtcagcagtgccttttagctacaaaaacattcacagtgaagccacagatgtgtgaatgttcttgtagctaacaagtaaggttgaccatactctactctagtcagttttattgatagtcttttcagtattattgataatctt

SEQ ID NO: 754 - DNA, 774 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgaaacacttccctgaattcctcgttttggccactgactgacgaggaattgggaagtgtttcaggacacaaggcctgttactagcactcacatggaacaaatggcccagatcctggaggcttgctgaaggctgtatgctgatgactatttcttccagagtggttttggccactgactgaccactctgggaaatagtcatcaggacacaaggcctgttactagcactcacatggaacaaatggcccagatcctggaggcttgctgaaggctgtatgctgatgggtgtgtcactgctctctgttttggccactgactgacagagagcagacacacccatcaggacacaaggcctgttactagcactcacatggaacaaatggcccagatcctggaggcttgctgaaggctgtatgctgaaccgatgtgcacatctatgcgttttggccactgactgacgcatagatgcacatcggttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 755 - DNA, 363 bp, Artificial sequence
  Synthetic
atctgatcttctgaagaaaatatatttctttttattcatagctcttaactagtggtgatagcaatgtcagcagtgcctttctcctgaggaaatgcgctgagtgaagccacagatgtcagcgcattccctcaggagacaagtaaggttgaccatactctactctagagttgtgttttaatgtatattaatgttactaatgtgtttactagtggtgatagcaatgtcagcagtgccttgaagcagtgactgcatctggcgtgaagccacagatggccagatgcaatcactgcttccaagtaaggttgaccatactctactctagtcagttttattgatagtcttttcagtattattgataatctt

SEQ ID NO: 756 - DNA, 363 bp, Artificial sequence
  Synthetic
atctgatcttctgaagaaaatatatttctttttattcatagctcttaactagtggtgatagcaatgtcagcagtgccttgagacatgagtcctgtggtgggtgaagccacagatgccaccacaggcctcatgtctccaagtaaggttgaccatactctactctagagttgtgttttaatgtatattaatgttactaatgtgtttactagtggtgatagcaatgtcagcagtgccttccaaggccatctccaaccagcgtgaagccacagatggctggttggaaatggccttggcaagtaaggttgaccatactctactctagtcagttttattgatagtcttttcagtattattgataatctt

SEQ ID NO: 757 - DNA, 363 bp, Artificial sequence
  Synthetic
atctgatcttctgaagaaaatatatttctttttattcatagctcttaactagtggtgatagcaatgtcagcagtgccttaggggacggtgacacctgctggtgaagccacagatgcagcaggtgtaaccgtcccctcaagtaaggttgaccatactctactctagagttgtgttttaatgtatattaatgttactaatgtgtttactagtggtgatagcaatgtcagcagtgccttaaaggtggaggggtttcctgcgtgaagccacagatggcaggaaaccactccacctttcaagtaaggttgaccatactctactctagtcagttttattgatagtcttttcagtattattgataatctt

SEQ ID NO: 758 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttctcctgaggaaatgcgctggttttggccactgactgaccagcgcatcctcaggagaacaggacacaaggcctgttactagcactcacatggaacaaatggcccagatcctggaggcttgctgaaggctgtatgctgattgagacatgagtcctgtgggttttggccactgactgacccacaggacatgtctcaatcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 759 - DNA, 363 bp, Artificial sequence
  Synthetic
atctgatcttctgaagaaaatatatttctttttattcatagctcttaactagtggtgatagcaatgtcagcagtgcctttgtagtacacgtaatttgggtgtgaagccacagatgacccaaattaagtgtactacacaagtaaggttgaccatactctactctagagttgtgttttaatgtatattaatgttactaatgtgtttactagtggtgatagcaatgtcagcagtgccttatatatgcaatacaacctttagtgaagccacagatgtaaaggttgtcttgcatatatcaagtaaggttgaccatactctactctagtcagttttattgatagtcttttcagtattattgataatctt

SEQ ID NO: 760 - DNA, 363 bp, Artificial sequence
  Synthetic
atctgatcttctgaagaaaatatatttctttttattcatagctcttaactagtggtgatagcaatgtcagcagtgcctttgacccacatcataatgctgcgtgaagccacagatggcagcattataatgtgggtcacaagtaaggttgaccatactctactctagagttgtgttttaatgtatattaatgttactaatgtgtttactagtggtgatagcaatgtcagcagtgccttacaatatagtcttctccctcggtgaagccacagatgcgagggagaaaactatattgtcaagtaaggttgaccatactctactctagtcagttttattgatagtcttttcagtattattgataatctt

SEQ ID NO: 761 - DNA, 363 bp, Artificial sequence
  Synthetic
atctgatcttctgaagaaaatatatttctttttattcatagctcttaactagtggtgatagcaatgtcagcagtgccttatatatgcaatacaacctttagtgaagccacagatgtaaaggttgtcttgcatatatcaagtaaggttgaccatactctactctagagttgtgttttaatgtatattaatgttactaatgtgtttactagtggtgatagcaatgtcagcagtgccttagtgtttatattcaaaccattgtgaagccacagatgaatggtttgactataaacactcaagtaaggttgaccatactctactctagtcagttttattgatagtcttttcagtattattgataatctt

SEQ ID NO: 762 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtgtagtacacgtaatttgggtgttttggccactgactgacacccaaatcgtgtactacacaggacacaaggcctgttactagcactcacatggaacaaatggcccagatcctggaggcttgctgaaggctgtatgctgtgatgtgacagaaacatcccagttttggccactgactgactgggatgtctgtcacatcacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 763 - DNA, 681 bp, Artificial sequence
  Synthetic
atctgatcttctgaagaaaatatatttctttttattcatagctcttaactagtggtgatagcaatgtcagcagtgccttgagacatgagtcctgtggtgggtgaagccacagatgccaccacaggcctcatgtctccaagtaaggttgaccatactctactctagttatattctttaggcacgaatgtgtgtttaaaaaaaataaaaactagtggtgatagcaatgtcagcagtgccttccaaggccatctccaaccagcgtgaagccacagatggctggttggaaatggccttggcaagtaaggttgaccatactctactctagagttgtgttttaatgtatattaatgttactaatgtgtttactagtggtgatagcaatgtcagcagtgcctttgtagtacacgtaatttgggtgtgaagccacagatgacccaaattaagtgtactacacaagtaaggttgaccatactctactctaggttatttttagtatgattctgtaaaaatgaattaatactaactagtggtgatagcaatgtcagcagtgccttatatatgcaatacaacctttagtgaagccacagatgtaaaggttgtcttgcatatatcaagtaaggttgaccatactctactctagtcagttttattgatagtcttttcagtattattgataatctt

SEQ ID NO: 764 - DNA, 681 bp, Artificial sequence
  Synthetic
atctgatcttctgaagaaaatatatttctttttattcatagctcttaactagtggtgatagcaatgtcagcagtgcctttctcctgaggaaatgcgctgagtgaagccacagatgtcagcgcattccctcaggagacaagtaaggttgaccatactctactctagttatattctttaggcacgaatgtgtgtttaaaaaaaataaaaactagtggtgatagcaatgtcagcagtgcctttgacccacatcataatgctgcgtgaagccacagatggcagcattataatgtgggtcacaagtaaggttgaccatactctactctagagttgtgttttaatgtatattaatgttactaatgtgtttactagtggtgatagcaatgtcagcagtgccttgaagcagtgactgcatctggcgtgaagccacagatggccagatgcaatcactgcttccaagtaaggttgaccatactctactctaggttatttttagtatgattctgtaaaaatgaattaatactaactagtggtgatagcaatgtcagcagtgccttacaatatagtcttctccctcggtgaagccacagatgcgagggagaaaactatattgtcaagtaaggttgaccatactctactctagtcagttttattgatagtcttttcagtattattgataatctt

SEQ ID NO: 765 - DNA, 681 bp, Artificial sequence
  Synthetic
atctgatcttctgaagaaaatatatttctttttattcatagctcttaactagtggtgatagcaatgtcagcagtgcctttgtagtacacgtaatttgggtgtgaagccacagatgacccaaattaagtgtactacacaagtaaggttgaccatactctactctagttatattctttaggcacgaatgtgtgtttaaaaaaaataaaaactagtggtgatagcaatgtcagcagtgccttgagacatgagtcctgtggtgggtgaagccacagatgccaccacaggcctcatgtctccaagtaaggttgaccatactctactctagagttgtgttttaatgtatattaatgttactaatgtgtttactagtggtgatagcaatgtcagcagtgcctttctcctgaggaaatgcgctgagtgaagccacagatgtcagcgcattccctcaggagacaagtaaggttgaccatactctactctaggttatttttagtatgattctgtaaaaatgaattaatactaactagtggtgatagcaatgtcagcagtgcctttgacccacatcataatgctgcgtgaagccacagatggcagcattataatgtgggtcacaagtaaggttgaccatactctactctagtcagttttattgatagtcttttcagtattattgataatctt

SEQ ID NO: 766 - DNA, 774 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttctcctgaggaaatgcgctggttttggccactgactgaccagcgcatcctcaggagaacaggacacaaggcctgttactagcactcacatggaacaaatggcccagatcctggaggcttgctgaaggctgtatgctgacctgaagcagtgactgcatcgttttggccactgactgacgatgcagtctgcttcaggtcaggacacaaggcctgttactagcactcacatggaacaaatggcccagatcctggaggcttgctgaaggctgtatgctgtgtagtacacgtaatttgggtgttttggccactgactgacacccaaatcgtgtactacacaggacacaaggcctgttactagcactcacatggaacaaatggcccagatcctggaggcttgctgaaggctgtatgctgtgatgtgacagaaacatcccagttttggccactgactgactgggatgtctgtcacatcacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 767 - DNA, 363 bp, Artificial sequence
  Synthetic
atctgatcttctgaagaaaatatatttctttttattcatagctcttaactagtggtgatagcaatgtcagcagtgcctttaagttcagtgcaggtcccaggtgaagccacagatgctgggacctgaactgaacttacaagtaaggttgaccatactctactctagagttgtgttttaatgtatattaatgttactaatgtgtttactagtggtgatagcaatgtcagcagtgcctttcaagatcaaggtagacctgggtgaagccacagatgccaggtctacattgatcttgacaagtaaggttgaccatactctactctagtcagttttattgatagtcttttcagtattattgataatctt

SEQ ID NO: 768 - DNA, 363 bp, Artificial sequence
  Synthetic
atctgatcttctgaagaaaatatatttctttttattcatagctcttaactagtggtgatagcaatgtcagcagtgcctttgagctctaacatccatgattgtgaagccacagatgaatcatggatattagagctcacaagtaaggttgaccatactctactctagagttgtgttttaatgtatattaatgttactaatgtgtttactagtggtgatagcaatgtcagcagtgccttaaatctcaacattccaagggagtgaagccacagatgtcccttggaacgttgagatttcaagtaaggttgaccatactctactctagtcagttttattgatagtcttttcagtattattgataatctt

SEQ ID NO: 769 - DNA, 363 bp, Artificial sequence
  Synthetic
atctgatcttctgaagaaaatatatttctttttattcatagctcttaactagtggtgatagcaatgtcagcagtgcctaaaaatacaacaaattagctgggtgaagccacagatgccagctaattcgttgtattttcaagtaaggttgaccatactctactctagagttgtgttttaatgtatattaatgttactaatgtgtttactagtggtgatagcaatgtcagcagtgcctttgtgtgtcagaattgtgctaggtgaagccacagatgctagcacaatcctgacacacacaagtaaggttgaccatactctactctagtcagttttattgatagtcttttcagtattattgataatctt

SEQ ID NO: 770 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttcccatgtgagtcattatctgttttggccactgactgacagataatgtcacatgggaacaggacacaaggcctgttactagcactcacatggaacaaatggcccagatcctggaggcttgctgaaggctgtatgctgatgacatgcctgtttaagttcgttttggccactgactgacgaacttaaaggcatgtcatcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 771 - DNA, 363 bp, Artificial sequence
  Synthetic
atctgatcttctgaagaaaatatatttctttttattcatagctcttaactagtggtgatagcaatgtcagcagtgcctttacaaaaaacataaaggccgggtgaagccacagatgccggcctttacgttttttgtacaagtaaggttgaccatactctactctagagttgtgttttaatgtatattaatgttactaatgtgtttactagtggtgatagcaatgtcagcagtgccttgtatttacagcagcactgggcgtgaagccacagatggcccagtgctactgtaaataccaagtaaggttgaccatactctactctagtcagttttattgatagtcttttcagtattattgataatctt

SEQ ID NO: 772 - DNA, 363 bp, Artificial sequence
  Synthetic
atctgatcttctgaagaaaatatatttctttttattcatagctcttaactagtggtgatagcaatgtcagcagtgccttttatgtacatgtggaaggagggtgaagccacagatgcctccttccaaatgtacataacaagtaaggttgaccatactctactctagagttgtgttttaatgtatattaatgttactaatgtgtttactagtggtgatagcaatgtcagcagtgcctataaatgtcagaatctgtcattgtgaagccacagatgaatgacagatcctgacatttacaagtaaggttgaccatactctactctagtcagttttattgatagtcttttcagtattattgataatctt

SEQ ID NO: 773 - DNA, 363 bp, Artificial sequence
  Synthetic
atctgatcttctgaagaaaatatatttctttttattcatagctcttaactagtggtgatagcaatgtcagcagtgcctataaatgtcagaatctgtcattgtgaagccacagatgaatgacagatcctgacatttacaagtaaggttgaccatactctactctagagttgtgttttaatgtatattaatgttactaatgtgtttactagtggtgatagcaatgtcagcagtgccttatattaaatatattaatcagagtgaagccacagatgtctgattaatctatttaatatcaagtaaggttgaccatactctactctagtcagttttattgatagtcttttcagtattattgataatctt

SEQ ID NO: 774 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgatgagagtgcgcatgtgcacagttttggccactgactgactgtgcacacgcactctcatcaggacacaaggcctgttactagcactcacatggaacaaatggcccagatcctggaggcttgctgaaggctgtatgctgagaaggtggagtcattctgcagttttggccactgactgactgcagaatctccaccttctcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 775 - DNA, 363 bp, Artificial sequence
  Synthetic
atctgatcttctgaagaaaatatatttctttttattcatagctcttaactagtggtgatagcaatgtcagcagtgcctttttctttagggatcaaggggggtgaagccacagatgcccccttgatacctaaagaaacaagtaaggttgaccatactctactctagagttgtgttttaatgtatattaatgttactaatgtgtttactagtggtgatagcaatgtcagcagtgccttttcttctgaacaacaaactgagtgaagccacagatgtcagtttgttattcagaagaacaagtaaggttgaccatactctactctagtcagttttattgatagtcttttcagtattattgataatctt

SEQ ID NO: 776 - DNA, 363 bp, Artificial sequence
  Synthetic
atctgatcttctgaagaaaatatatttctttttattcatagctcttaactagtggtgatagcaatgtcagcagtgccttttcttctgaacaacaaactgagtgaagccacagatgtcagtttgttattcagaagaacaagtaaggttgaccatactctactctagagttgtgttttaatgtatattaatgttactaatgtgtttactagtggtgatagcaatgtcagcagtgcctttttactatatattacagctttgtgaagccacagatgaaagctgtaacatatagtaaacaagtaaggttgaccatactctactctagtcagttttattgatagtcttttcagtattattgataatctt

SEQ ID NO: 777 - DNA, 363 bp, Artificial sequence
  Synthetic
atctgatcttctgaagaaaatatatttctttttattcatagctcttaactagtggtgatagcaatgtcagcagtgccttttcttctgaacaacaaactgagtgaagccacagatgtcagtttgttattcagaagaacaagtaaggttgaccatactctactctagagttgtgttttaatgtatattaatgttactaatgtgtttactagtggtgatagcaatgtcagcagtgccttaaatttacaagcctttgccttgtgaagccacagatgaaggcaaaggattgtaaatttcaagtaaggttgaccatactctactctagtcagttttattgatagtcttttcagtattattgataatctt

SEQ ID NO: 778 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttcctttgaagtgcttgggaggttttggccactgactgacctcccaagcttcaaaggaacaggacacaaggcctgttactagcactcacatggaacaaatggcccagatcctggaggcttgctgaaggctgtatgctgttccattatcattccagttccgttttggccactgactgacggaactggtgataatggaacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 779 - DNA, 363 bp, Artificial sequence
  Synthetic
atctgatcttctgaagaaaatatatttctttttattcatagctcttaactagtggtgatagcaatgtcagcagtgccttaggtttccaaacctatcccttgtgaagccacagatgaagggataggcttggaaacctcaagtaaggttgaccatactctactctagagttgtgttttaatgtatattaatgttactaatgtgtttactagtggtgatagcaatgtcagcagtgccttaaaacagttatattatcctttgtgaagccacagatgaaaggataatctaactgttttcaagtaaggttgaccatactctactctagtcagttttattgatagtcttttcagtattattgataatctt

SEQ ID NO: 780 - DNA, 363 bp, Artificial sequence
  Synthetic
atctgatcttctgaagaaaatatatttctttttattcatagctcttaactagtggtgatagcaatgtcagcagtgccttaaaacagttatattatcctttgtgaagccacagatgaaaggataatctaactgttttcaagtaaggttgaccatactctactctagagttgtgttttaatgtatattaatgttactaatgtgtttactagtggtgatagcaatgtcagcagtgccttaatcctccatctttcaccattgtgaagccacagatgaatggtgaaaaatggaggattcaagtaaggttgaccatactctactctagtcagttttattgatagtcttttcagtattattgataatctt

SEQ ID NO: 781 - DNA, 363 bp, Artificial sequence
  Synthetic
atctgatcttctgaagaaaatatatttctttttattcatagctcttaactagtggtgatagcaatgtcagcagtgccttaaaacagttatattatcctttgtgaagccacagatgaaaggataatctaactgttttcaagtaaggttgaccatactctactctagagttgtgttttaatgtatattaatgttactaatgtgtttactagtggtgatagcaatgtcagcagtgcctttgtttttaaatacaaagcaacgtgaagccacagatggttgctttgtctttaaaaacacaagtaaggttgaccatactctactctagtcagttttattgatagtcttttcagtattattgataatctt

SEQ ID NO: 782 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgaaacctatccctttgctgcgtgttttggccactgactgacacgcagcagggataggtttcaggacacaaggcctgttactagcactcacatggaacaaatggcccagatcctggaggcttgctgaaggctgtatgctgagtctttgctttctacaggaggttttggccactgactgacctcctgtaaagcaaagactcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 783 - DNA, 999 bp, Artificial sequence
  Synthetic
atctgatcttctgaagaaaatatatttctttttattcatagctcttaactagtggtgatagcaatgtcagcagtgcctataaatgtcagaatctgtcattgtgaagccacagatgaatgacagatcctgacatttacaagtaaggttgaccatactctactctagttatattctttaggcacgaatgtgtgtttaaaaaaaataaaaactagtggtgatagcaatgtcagcagtgccttatattaaatatattaatcagagtgaagccacagatgtctgattaatctatttaatatcaagtaaggttgaccatactctactctagagttgtgttttaatgtatattaatgttactaatgtgtttactagtggtgatagcaatgtcagcagtgccttttcttctgaacaacaaactgagtgaagccacagatgtcagtttgttattcagaagaacaagtaaggttgaccatactctactctaggttatttttagtatgattctgtaaaaatgaattaatactaactagtggtgatagcaatgtcagcagtgcctttttactatatattacagctttgtgaagccacagatgaaagctgtaacatatagtaaacaagtaaggttgaccatactctactctagatttttcagatgtatcatctcttaaaatactgtaattgcaactagtggtgatagcaatgtcagcagtgccttaaaacagttatattatcctttgtgaagccacagatgaaaggataatctaactgttttcaagtaaggttgaccatactctactctagttatattctttaggcacgaatgtgtgtttaaaaaaaataaaaactagtggtgatagcaatgtcagcagtgccttaaatataaaacacaaccccaagtgaagccacagatgttggggttgtattttatatttcaagtaaggttgaccatactctactctagtcagttttattgatagtcttttcagtattattgataatctt

SEQ ID NO: 784 - DNA, 999 bp, Artificial sequence
  Synthetic
atctgatcttctgaagaaaatatatttctttttattcatagctcttaactagtggtgatagcaatgtcagcagtgccttgtatttacagcagcactgggcgtgaagccacagatggcccagtgctactgtaaataccaagtaaggttgaccatactctactctagttatattctttaggcacgaatgtgtgtttaaaaaaaataaaaactagtggtgatagcaatgtcagcagtgcctttttctttagggatcaaggggggtgaagccacagatgcccccttgatacctaaagaaacaagtaaggttgaccatactctactctagagttgtgttttaatgtatattaatgttactaatgtgtttactagtggtgatagcaatgtcagcagtgccttttcttctgaacaacaaactgagtgaagccacagatgtcagtttgttattcagaagaacaagtaaggttgaccatactctactctaggttatttttagtatgattctgtaaaaatgaattaatactaactagtggtgatagcaatgtcagcagtgccttaggtttccaaacctatcccttgtgaagccacagatgaagggataggcttggaaacctcaagtaaggttgaccatactctactctagatttttcagatgtatcatctcttaaaatactgtaattgcaactagtggtgatagcaatgtcagcagtgccttaaaacagttatattatcctttgtgaagccacagatgaaaggataatctaactgttttcaagtaaggttgaccatactctactctagttatattctttaggcacgaatgtgtgtttaaaaaaaataaaaactagtggtgatagcaatgtcagcagtgccttttatgtacatgtggaaggagggtgaagccacagatgcctccttccaaatgtacataacaagtaaggttgaccatactctactctagtcagttttattgatagtcttttcagtattattgataatctt

SEQ ID NO: 785 - DNA, 999 bp, Artificial sequence
  Synthetic
atctgatcttctgaagaaaatatatttctttttattcatagctcttaactagtggtgatagcaatgtcagcagtgcctttacaaaaaacataaaggccgggtgaagccacagatgccggcctttacgttttttgtacaagtaaggttgaccatactctactctagttatattctttaggcacgaatgtgtgtttaaaaaaaataaaaactagtggtgatagcaatgtcagcagtgccttatattaaatatattaatcagagtgaagccacagatgtctgattaatctatttaatatcaagtaaggttgaccatactctactctagagttgtgttttaatgtatattaatgttactaatgtgtttactagtggtgatagcaatgtcagcagtgccttttcttctgaacaacaaactgagtgaagccacagatgtcagtttgttattcagaagaacaagtaaggttgaccatactctactctaggttatttttagtatgattctgtaaaaatgaattaatactaactagtggtgatagcaatgtcagcagtgccttaggtttccaaacctatcccttgtgaagccacagatgaagggataggcttggaaacctcaagtaaggttgaccatactctactctagatttttcagatgtatcatctcttaaaatactgtaattgcaactagtggtgatagcaatgtcagcagtgccttaaaacagttatattatcctttgtgaagccacagatgaaaggataatctaactgttttcaagtaaggttgaccatactctactctagttatattctttaggcacgaatgtgtgtttaaaaaaaataaaaactagtggtgatagcaatgtcagcagtgcctttttctttagggatcaaggggggtgaagccacagatgcccccttgatacctaaagaaacaagtaaggttgaccatactctactctagtcagttttattgatagtcttttcagtattattgataatctt

SEQ ID NO: 786 - DNA, 1095 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgagaaggtggagtcattctgcagttttggccactgactgactgcagaatctccaccttctcaggacacaaggcctgttactagcactcacatggaacaaatggcccagatcctggaggcttgctgaaggctgtatgctgcttatttacagcacggcgctagttttggccactgactgactagcgccgctgtaaataagcaggacacaaggcctgttactagcactcacatggaacaaatggcccagatcctggaggcttgctgaaggctgtatgctgttcctttgaagtgcttgggaggttttggccactgactgacctcccaagcttcaaaggaacaggacacaaggcctgttactagcactcacatggaacaaatggcccagatcctggaggcttgctgaaggctgtatgctgaaacctatccctttgctgcgtgttttggccactgactgacacgcagcagggataggtttcaggacacaaggcctgttactagcactcacatggaacaaatggcccagatcctggaggcttgctgaaggctgtatgctgagtctttgctttctacaggaggttttggccactgactgacctcctgtaaagcaaagactcaggacacaaggcctgttactagcactcacatggaacaaatggcccagatcctggaggcttgctgaaggctgtatgctgatgccacccacgcaacatttagttttggccactgactgactaaatgttgtgggtggcatcaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 787 - DNA, 1095 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgagaaggtggagtcattctgcagttttggccactgactgactgcagaatctccaccttctcaggacacaaggcctgttactagcactcacatggaacaaatggcccagatcctggaggcttgctgaaggctgtatgctgttccattatcattccagttccgttttggccactgactgacggaactggtgataatggaacaggacacaaggcctgttactagcactcacatggaacaaatggcccagatcctggaggcttgctgaaggctgtatgctgatgccacccacgcaacatttagttttggccactgactgactaaatgttgtgggtggcatcaggacacaaggcctgttactagcactcacatggaacaaatggcccagatcctggaggcttgctgaaggctgtatgctgagtctttgctttctacaggaggttttggccactgactgacctcctgtaaagcaaagactcaggacacaaggcctgttactagcactcacatggaacaaatggcccagatcctggaggcttgctgaaggctgtatgctgtttaagacacatcctaccctggttttggccactgactgaccagggtagtgtgtcttaaacaggacacaaggcctgttactagcactcacatggaacaaatggcccagatcctggaggcttgctgaaggctgtatgctgatgagagtgcgcatgtgcacagttttggccactgactgactgtgcacacgcactctcatcaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 788 - DNA, 1095 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgatgagagtgcgcatgtgcacagttttggccactgactgactgtgcacacgcactctcatcaggacacaaggcctgttactagcactcacatggaacaaatggcccagatcctggaggcttgctgaaggctgtatgctgagaaggtggagtcattctgcagttttggccactgactgactgcagaatctccaccttctcaggacacaaggcctgttactagcactcacatggaacaaatggcccagatcctggaggcttgctgaaggctgtatgctgttcctttgaagtgcttgggaggttttggccactgactgacctcccaagcttcaaaggaacaggacacaaggcctgttactagcactcacatggaacaaatggcccagatcctggaggcttgctgaaggctgtatgctgttccattatcattccagttccgttttggccactgactgacggaactggtgataatggaacaggacacaaggcctgttactagcactcacatggaacaaatggcccagatcctggaggcttgctgaaggctgtatgctgaaacctatccctttgctgcgtgttttggccactgactgacacgcagcagggataggtttcaggacacaaggcctgttactagcactcacatggaacaaatggcccagatcctggaggcttgctgaaggctgtatgctgagtctttgctttctacaggaggttttggccactgactgacctcctgtaaagcaaagactcaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 789 - DNA, 363 bp, Artificial sequence
  Synthetic
atctgatcttctgaagaaaatatatttctttttattcatagctcttaactagtggtgatagcaatgtcagcagtgccttgagagtccgcttagtgcccatgtgaagccacagatgatgggcactacgcggactctccaagtaaggttgaccatactctactctagagttgtgttttaatgtatattaatgttactaatgtgtttactagtggtgatagcaatgtcagcagtgccttaacaggtgatcttgtctgggcgtgaagccacagatggcccagacaaaatcacctgttcaagtaaggttgaccatactctactctagtcagttttattgatagtcttttcagtattattgataatctt

SEQ ID NO: 790 - DNA, 363 bp, Artificial sequence
  Synthetic
atctgatcttctgaagaaaatatatttctttttattcatagctcttaactagtggtgatagcaatgtcagcagtgcctaacaccattaagatcaaccagggtgaagccacagatgcctggttgatattaatggtgtcaagtaaggttgaccatactctactctagagttgtgttttaatgtatattaatgttactaatgtgtttactagtggtgatagcaatgtcagcagtgcctaataataataacaaacgcgtatgtgaagccacagatgatacgcgtttattattattatcaagtaaggttgaccatactctactctagtcagttttattgatagtcttttcagtattattgataatctt

SEQ ID NO: 791 - DNA, 363 bp, Artificial sequence
  Synthetic
atctgatcttctgaagaaaatatatttctttttattcatagctcttaactagtggtgatagcaatgtcagcagtgccttgtctcatgtagaatgtgctttgtgaagccacagatgaaagcacattatacatgagaccaagtaaggttgaccatactctactctagagttgtgttttaatgtatattaatgttactaatgtgtttactagtggtgatagcaatgtcagcagtgcctttgtgttagcaggactgcgtgcgtgaagccacagatggcacgcagtcatgctaacacacaagtaaggttgaccatactctactctagtcagttttattgatagtcttttcagtattattgataatctt

SEQ ID NO: 792 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtacagaaggtgtcttgctatagttttggccactgactgactatagcaacaccttctgtacaggacacaaggcctgttactagcactcacatggaacaaatggcccagatcctggaggcttgctgaaggctgtatgctgttaagtgagagtccgcttagtgttttggccactgactgacactaagcgctctcacttaacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 793 - DNA, 361 bp, Artificial sequence
  Synthetic
atctgatcttctgaagaaaatatatttctttttattcatagctcttaactagtggtgatagcaatgtcagcagtgccttagattttaaacatccttggagtgaagccacagatgtccaaggatatttaaaatctcaagtaaggttgaccatactctactctagagttgtgttttaatgtatattaatgttactaatgtgtttactagtggtgatagcaatgtcagcagtgcctttaatctttcatcctctgcatagtgaagccacagatgtatgcagaggctgaaagattacaagtaaggttgaccatactctactctagtcagttttattgatagtcttttcagtattattgataatctt

SEQ ID NO: 794 - DNA, 361 bp, Artificial sequence
  Synthetic
atctgatcttctgaagaaaatatatttctttttattcatagctcttaactagtggtgatagcaatgtcagcagtgccttagattttaaacatccttggagtgaagccacagatgtccaaggatatttaaaatctcaagtaaggttgaccatactctactctagagttgtgttttaatgtatattaatgttactaatgtgtttactagtggtgatagcaatgtcagcagtgccttaatatgacaccaataaactgtgtgaagccacagatgacagtttattagtgtcatattcaagtaaggttgaccatactctactctagtcagttttattgatagtcttttcagtattattgataatctt

SEQ ID NO: 795 - DNA, 363 bp, Artificial sequence
  Synthetic
atctgatcttctgaagaaaatatatttctttttattcatagctcttaactagtggtgatagcaatgtcagcagtgcctttactcttgatgaagtttgtttgtgaagccacagatgaaacaaacttaatcaagagtacaagtaaggttgaccatactctactctagagttgtgttttaatgtatattaatgttactaatgtgtttactagtggtgatagcaatgtcagcagtgcctttaatctttcatcctctgcatagtgaagccacagatgtatgcagaggctgaaagattacaagtaaggttgaccatactctactctagtcagttttattgatagtcttttcagtattattgataatctt

SEQ ID NO: 796 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgaaaccaagcagtatttacagcgttttggccactgactgacgctgtaaactgcttggtttcaggacacaaggcctgttactagcactcacatggaacaaatggcccagatcctggaggcttgctgaaggctgtatgctgatatgttggctcttcagcgctgttttggccactgactgacagcgctgaagccaacatatcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 797 - DNA, 363 bp, Artificial sequence
  Synthetic
atctgatcttctgaagaaaatatatttctttttattcatagctcttaactagtggtgatagcaatgtcagcagtgcctaaatataccatcttctcacttggtgaagccacagatgcaagtgagaaaatggtatattcaagtaaggttgaccatactctactctagagttgtgttttaatgtatattaatgttactaatgtgtttactagtggtgatagcaatgtcagcagtgccttatgtcttaaagtaccctctgcgtgaagccacagatggcagagggtaatttaagacatcaagtaaggttgaccatactctactctagtcagttttattgatagtcttttcagtattattgataatctt

SEQ ID NO: 798 - DNA, 363 bp, Artificial sequence
  Synthetic
atctgatcttctgaagaaaatatatttctttttattcatagctcttaactagtggtgatagcaatgtcagcagtgccttatgtcttaaagtaccctctgcgtgaagccacagatggcagagggtaatttaagacatcaagtaaggttgaccatactctactctagagttgtgttttaatgtatattaatgttactaatgtgtttactagtggtgatagcaatgtcagcagtgcctttgaggtagcttcatagtggttgtgaagccacagatgaaccactatgcagctacctcacaagtaaggttgaccatactctactctagtcagttttattgatagtcttttcagtattattgataatctt

SEQ ID NO: 799 - DNA, 363 bp, Artificial sequence
  Synthetic
atctgatcttctgaagaaaatatatttctttttattcatagctcttaactagtggtgatagcaatgtcagcagtgcctttgaggtagcttcatagtggttgtgaagccacagatgaaccactatgcagctacctcacaagtaaggttgaccatactctactctagagttgtgttttaatgtatattaatgttactaatgtgtttactagtggtgatagcaatgtcagcagtgccttaattcaattgcaactacctgagtgaagccacagatgtcaggtagttacaattgaattcaagtaaggttgaccatactctactctagtcagttttattgatagtcttttcagtattattgataatctt

SEQ ID NO: 800 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgataaattcaagcttgtcggcagttttggccactgactgactgccgacacttgaatttatcaggacacaaggcctgttactagcactcacatggaacaaatggcccagatcctggaggcttgctgaaggctgtatgctgaaaggactcaaattctgttgcgttttggccactgactgacgcaacagattgagtcctttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 801 - DNA, 363 bp, Artificial sequence
  Synthetic
atctgatcttctgaagaaaatatatttctttttattcatagctcttaactagtggtgatagcaatgtcagcagtgccttttcctgaaattaaaatcctgggtgaagccacagatgccaggattttcatttcaggaacaagtaaggttgaccatactctactctagagttgtgttttaatgtatattaatgttactaatgtgtttactagtggtgatagcaatgtcagcagtgccttgtattaagtctattaacaagggtgaagccacagatgccttgttaatcgacttaataccaagtaaggttgaccatactctactctagtcagttttattgatagtcttttcagtattattgataatctt

SEQ ID NO: 802 - DNA, 363 bp, Artificial sequence
  Synthetic
atctgatcttctgaagaaaatatatttctttttattcatagctcttaactagtggtgatagcaatgtcagcagtgccttacaaagagaaaattaatcttagtgaagccacagatgtaagattaatcttctctttgtcaagtaaggttgaccatactctactctagagttgtgttttaatgtatattaatgttactaatgtgtttactagtggtgatagcaatgtcagcagtgccttgtattaagtctattaacaagggtgaagccacagatgccttgttaatcgacttaataccaagtaaggttgaccatactctactctagtcagttttattgatagtcttttcagtattattgataatctt

SEQ ID NO: 803 - DNA, 363 bp, Artificial sequence
  Synthetic
atctgatcttctgaagaaaatatatttctttttattcatagctcttaactagtggtgatagcaatgtcagcagtgccttttcctgaaattaaaatcctgggtgaagccacagatgccaggattttcatttcaggaacaagtaaggttgaccatactctactctagagttgtgttttaatgtatattaatgttactaatgtgtttactagtggtgatagcaatgtcagcagtgcctttttgcatgaaaatctgccctagtgaagccacagatgtagggcagatcttcatgcaaacaagtaaggttgaccatactctactctagtcagttttattgatagtcttttcagtattattgataatctt

SEQ ID NO: 804 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgattgcttctcagctagaatgtgttttggccactgactgacacattctatgagaagcaatcaggacacaaggcctgttactagcactcacatggaacaaatggcccagatcctggaggcttgctgaaggctgtatgctgaattgcagtggacacagccatgttttggccactgactgacatggctgtccactgcaattcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 805 - DNA, 363 bp, Artificial sequence
  Synthetic
atctgatcttctgaagaaaatatatttctttttattcatagctcttaactagtggtgatagcaatgtcagcagtgccttatttttaaaaaattagccagggtgaagccacagatgcctggctaatcttttaaaaatcaagtaaggttgaccatactctactctagagttgtgttttaatgtatattaatgttactaatgtgtttactagtggtgatagcaatgtcagcagtgcctttagtaaataaacatagtgttagtgaagccacagatgtaacactatgcttatttactacaagtaaggttgaccatactctactctagtcagttttattgatagtcttttcagtattattgataatctt

SEQ ID NO: 806 - DNA, 363 bp, Artificial sequence
  Synthetic
atctgatcttctgaagaaaatatatttctttttattcatagctcttaactagtggtgatagcaatgtcagcagtgccttatctaaatagtaccatcggccgtgaagccacagatgggccgatggtcctatttagatcaagtaaggttgaccatactctactctagagttgtgttttaatgtatattaatgttactaatgtgtttactagtggtgatagcaatgtcagcagtgcctttagtaaataaacatagtgttagtgaagccacagatgtaacactatgcttatttactacaagtaaggttgaccatactctactctagtcagttttattgatagtcttttcagtattattgataatctt

SEQ ID NO: 807 - DNA, 363 bp, Artificial sequence
  Synthetic
atctgatcttctgaagaaaatatatttctttttattcatagctcttaactagtggtgatagcaatgtcagcagtgcctttagtaaataaacatagtgttagtgaagccacagatgtaacactatgcttatttactacaagtaaggttgaccatactctactctagagttgtgttttaatgtatattaatgttactaatgtgtttactagtggtgatagcaatgtcagcagtgcctttaataaagtagaaaatctagagtgaagccacagatgtctagattttatactttattacaagtaaggttgaccatactctactctagtcagttttattgatagtcttttcagtattattgataatctt

SEQ ID NO: 808 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtaaatagggttgctcctctgagttttggccactgactgactcagaggaaaccctatttacaggacacaaggcctgttactagcactcacatggaacaaatggcccagatcctggaggcttgctgaaggctgtatgctgaacacagttattcacagtggcgttttggccactgactgacgccactgtataactgtgttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 809 - DNA, 363 bp, Artificial sequence
  Synthetic
atctgatcttctgaagaaaatatatttctttttattcatagctcttaactagtggtgatagcaatgtcagcagtgcctttgagttgcaggaaagtccagggtgaagccacagatgcctggactttactgcaactcacaagtaaggttgaccatactctactctagagttgtgttttaatgtatattaatgttactaatgtgtttactagtggtgatagcaatgtcagcagtgcctttgtcgtcaatctggaagctgcgtgaagccacagatggcagcttccaaattgacgacacaagtaaggttgaccatactctactctagtcagttttattgatagtcttttcagtattattgataatctt

SEQ ID NO: 810 - DNA, 363 bp, Artificial sequence
  Synthetic
atctgatcttctgaagaaaatatatttctttttattcatagctcttaactagtggtgatagcaatgtcagcagtgcctttgagttgcaggaaagtccagggtgaagccacagatgcctggactttactgcaactcacaagtaaggttgaccatactctactctagagttgtgttttaatgtatattaatgttactaatgtgtttactagtggtgatagcaatgtcagcagtgccttttttgtttggcaccactcagggtgaagccacagatgcctgagtggtaccaaacaaaacaagtaaggttgaccatactctactctagtcagttttattgatagtcttttcagtattattgataatctt

SEQ ID NO: 811 - DNA, 363 bp, Artificial sequence
  Synthetic
atctgatcttctgaagaaaatatatttctttttattcatagctcttaactagtggtgatagcaatgtcagcagtgcctttgtcgtcaatctggaagctgcgtgaagccacagatggcagcttccaaattgacgacacaagtaaggttgaccatactctactctagagttgtgttttaatgtatattaatgttactaatgtgtttactagtggtgatagcaatgtcagcagtgccttagtgcagaggttaatccctgcgtgaagccacagatggcagggattaccctctgcactcaagtaaggttgaccatactctactctagtcagttttattgatagtcttttcagtattattgataatctt

SEQ ID NO: 812 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttgagttgcaggaaagtccaggttttggccactgactgacctggacttctgcaactcaacaggacacaaggcctgttactagcactcacatggaacaaatggcccagatcctggaggcttgctgaaggctgtatgctgagcacttgtcgtcaatctggagttttggccactgactgactccagattcgacaagtgctcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 813 - DNA, 363 bp, Artificial sequence
  Synthetic
atctgatcttctgaagaaaatatatttctttttattcatagctcttaactagtggtgatagcaatgtcagcagtgcctttcagaagtctcaactttgtgggtgaagccacagatgccacaaagttaagacttctgacaagtaaggttgaccatactctactctagagttgtgttttaatgtatattaatgttactaatgtgtttactagtggtgatagcaatgtcagcagtgcctttaaattgtttaaccatccgctgtgaagccacagatgagcggatggtcaaacaatttacaagtaaggttgaccatactctactctagtcagttttattgatagtcttttcagtattattgataatctt

SEQ ID NO: 814 - DNA, 363 bp, Artificial sequence
  Synthetic
atctgatcttctgaagaaaatatatttctttttattcatagctcttaactagtggtgatagcaatgtcagcagtgcctttttagaagtatgtttacgatggtgaagccacagatgcatcgtaaacctacttctaaacaagtaaggttgaccatactctactctagagttgtgttttaatgtatattaatgttactaatgtgtttactagtggtgatagcaatgtcagcagtgcctttaaattgtttaaccatccgctgtgaagccacagatgagcggatggtcaaacaatttacaagtaaggttgaccatactctactctagtcagttttattgatagtcttttcagtattattgataatctt

SEQ ID NO: 815 - DNA, 363 bp, Artificial sequence
  Synthetic
atctgatcttctgaagaaaatatatttctttttattcatagctcttaactagtggtgatagcaatgtcagcagtgccttttctaaataaagaaaatgggagtgaagccacagatgtcccattttccttatttagaacaagtaaggttgaccatactctactctagagttgtgttttaatgtatattaatgttactaatgtgtttactagtggtgatagcaatgtcagcagtgcctttaaattgtttaaccatccgctgtgaagccacagatgagcggatggtcaaacaatttacaagtaaggttgaccatactctactctagtcagttttattgatagtcttttcagtattattgataatctt

SEQ ID NO: 816 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttcagaagtctcaactttgtggttttggccactgactgaccacaaagtagacttctgaacaggacacaaggcctgttactagcactcacatggaacaaatggcccagatcctggaggcttgctgaaggctgtatgctgagaaagatgacacaggtacacgttttggccactgactgacgtgtacctgtcatctttctcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 817 - DNA, 363 bp, Artificial sequence
  Synthetic
atctgatcttctgaagaaaatatatttctttttattcatagctcttaactagtggtgatagcaatgtcagcagtgccttgtattaactcctaacacctaagtgaagccacagatgttaggtgttaagagttaataccaagtaaggttgaccatactctactctagagttgtgttttaatgtatattaatgttactaatgtgtttactagtggtgatagcaatgtcagcagtgccttaatttttgtatttttttgtaagtgaagccacagatgttacaaaaaactacaaaaattcaagtaaggttgaccatactctactctagtcagttttattgatagtcttttcagtattattgataatctt

SEQ ID NO: 818 - DNA, 363 bp, Artificial sequence
  Synthetic
atctgatcttctgaagaaaatatatttctttttattcatagctcttaactagtggtgatagcaatgtcagcagtgcctttaaaaaaaaaaaaaacctaatgtgaagccacagatgattaggttttctttttttttacaagtaaggttgaccatactctactctagagttgtgttttaatgtatattaatgttactaatgtgtttactagtggtgatagcaatgtcagcagtgcctttatcttgagacagagtcttgcgtgaagccacagatggcaagactctatctcaagatacaagtaaggttgaccatactctactctagtcagttttattgatagtcttttcagtattattgataatctt

SEQ ID NO: 819 - DNA, 363 bp, Artificial sequence
  Synthetic
atctgatcttctgaagaaaatatatttctttttattcatagctcttaactagtggtgatagcaatgtcagcagtgccttgtattaactcctaacacctaagtgaagccacagatgttaggtgttaagagttaataccaagtaaggttgaccatactctactctagagttgtgttttaatgtatattaatgttactaatgtgtttactagtggtgatagcaatgtcagcagtgcctttatcttgagacagagtcttgcgtgaagccacagatggcaagactctatctcaagatacaagtaaggttgaccatactctactctagtcagttttattgatagtcttttcagtattattgataatctt

SEQ ID NO: 820 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtgaacttctgacctcaagtgagttttggccactgactgactcacttgatcagaagttcacaggacacaaggcctgttactagcactcacatggaacaaatggcccagatcctggaggcttgctgaaggctgtatgctgaatatatgcacacaccatcacgttttggccactgactgacgtgatggtgtgcatatattcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 821 - DNA, 363 bp, Artificial sequence
  Synthetic
atctgatcttctgaagaaaatatatttctttttattcatagctcttaactagtggtgatagcaatgtcagcagtgccttgtgaaaacaatgacatcccaagtgaagccacagatgttgggatgtccttgttttcaccaagtaaggttgaccatactctactctagagttgtgttttaatgtatattaatgttactaatgtgtttactagtggtgatagcaatgtcagcagtgccttcatatagtatcaagtgaagtcgtgaagccacagatggacttcacttaatactatatgcaagtaaggttgaccatactctactctagtcagttttattgatagtcttttcagtattattgataatctt

SEQ ID NO: 822 - DNA, 363 bp, Artificial sequence
  Synthetic
atctgatcttctgaagaaaatatatttctttttattcatagctcttaactagtggtgatagcaatgtcagcagtgcctaaaagttacaggatgttccatcgtgaagccacagatggatggaacatactgtaactttcaagtaaggttgaccatactctactctagagttgtgttttaatgtatattaatgttactaatgtgtttactagtggtgatagcaatgtcagcagtgccttcatatagtatcaagtgaagtcgtgaagccacagatggacttcacttaatactatatgcaagtaaggttgaccatactctactctagtcagttttattgatagtcttttcagtattattgataatctt

SEQ ID NO: 823 - DNA, 363 bp, Artificial sequence
  Synthetic
atctgatcttctgaagaaaatatatttctttttattcatagctcttaactagtggtgatagcaatgtcagcagtgcctttacattaggataaaaaagtgcgtgaagccacagatggcacttttttctcctaatgtacaagtaaggttgaccatactctactctagagttgtgttttaatgtatattaatgttactaatgtgtttactagtggtgatagcaatgtcagcagtgccttcatatagtatcaagtgaagtcgtgaagccacagatggacttcacttaatactatatgcaagtaaggttgaccatactctactctagtcagttttattgatagtcttttcagtattattgataatctt

SEQ ID NO: 824 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgaattgtggcactttcctactggttttggccactgactgaccagtaggagtgccacaattcaggacacaaggcctgttactagcactcacatggaacaaatggcccagatcctggaggcttgctgaaggctgtatgctgaaacaatgacatcccaaaccagttttggccactgactgactggtttggtgtcattgtttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 825 - DNA, 681 bp, Artificial sequence
  Synthetic
atctgatcttctgaagaaaatatatttctttttattcatagctcttaactagtggtgatagcaatgtcagcagtgccttgtattaactcctaacacctaagtgaagccacagatgttaggtgttaagagttaataccaagtaaggttgaccatactctactctagttatattctttaggcacgaatgtgtgtttaaaaaaaataaaaactagtggtgatagcaatgtcagcagtgcctttatcttgagacagagtcttgcgtgaagccacagatggcaagactctatctcaagatacaagtaaggttgaccatactctactctagagttgtgttttaatgtatattaatgttactaatgtgtttactagtggtgatagcaatgtcagcagtgccttgtgaaaacaatgacatcccaagtgaagccacagatgttgggatgtccttgttttcaccaagtaaggttgaccatactctactctaggttatttttagtatgattctgtaaaaatgaattaatactaactagtggtgatagcaatgtcagcagtgccttcatatagtatcaagtgaagtcgtgaagccacagatggacttcacttaatactatatgcaagtaaggttgaccatactctactctagtcagttttattgatagtcttttcagtattattgataatctt

SEQ ID NO: 826 - DNA, 774 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtgaacttctgacctcaagtgagttttggccactgactgactcacttgatcagaagttcacaggacacaaggcctgttactagcactcacatggaacaaatggcccagatcctggaggcttgctgaaggctgtatgctgtaaagacggcatttcacgatggttttggccactgactgaccatcgtgatgccgtctttacaggacacaaggcctgttactagcactcacatggaacaaatggcccagatcctggaggcttgctgaaggctgtatgctgaattgtggcactttcctactggttttggccactgactgaccagtaggagtgccacaattcaggacacaaggcctgttactagcactcacatggaacaaatggcccagatcctggaggcttgctgaaggctgtatgctgaaacaatgacatcccaaaccagttttggccactgactgactggtttggtgtcattgtttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 827 - DNA, 363 bp, Artificial sequence
  Synthetic
atctgatcttctgaagaaaatatatttctttttattcatagctcttaactagtggtgatagcaatgtcagcagtgcctttcattagaatttttttccaatgtgaagccacagatgattggaaaaacattctaatgacaagtaaggttgaccatactctactctagagttgtgttttaatgtatattaatgttactaatgtgtttactagtggtgatagcaatgtcagcagtgcctttgcatcctaaggacaaactgtgtgaagccacagatgacagtttgtcattaggatgcacaagtaaggttgaccatactctactctagtcagttttattgatagtcttttcagtattattgataatctt

SEQ ID NO: 828 - DNA, 363 bp, Artificial sequence
  Synthetic
atctgatcttctgaagaaaatatatttctttttattcatagctcttaactagtggtgatagcaatgtcagcagtgccttacattaatattattcatccaagtgaagccacagatgttggatgaatcatattaatgtcaagtaaggttgaccatactctactctagagttgtgttttaatgtatattaatgttactaatgtgtttactagtggtgatagcaatgtcagcagtgccttaaaataccaatttcttccaaagtgaagccacagatgtttggaagaacttggtattttcaagtaaggttgaccatactctactctagtcagttttattgatagtcttttcagtattattgataatctt

SEQ ID NO: 829 - DNA, 363 bp, Artificial sequence
  Synthetic
atctgatcttctgaagaaaatatatttctttttattcatagctcttaactagtggtgatagcaatgtcagcagtgcctttcattagaatttttttccaatgtgaagccacagatgattggaaaaacattctaatgacaagtaaggttgaccatactctactctagagttgtgttttaatgtatattaatgttactaatgtgtttactagtggtgatagcaatgtcagcagtgccttaaaataccaatttcttccaaagtgaagccacagatgtttggaagaacttggtattttcaagtaaggttgaccatactctactctagtcagttttattgatagtcttttcagtattattgataatctt

SEQ ID NO: 830 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgatgaatgcaatactgcacaacgttttggccactgactgacgttgtgcaattgcattcatcaggacacaaggcctgttactagcactcacatggaacaaatggcccagatcctggaggcttgctgaaggctgtatgctgtttaccaacagtacaacaagggttttggccactgactgacccttgttgctgttggtaaacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 831 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttcatttgcatcctaaggacagttttggccactgactgactgtccttaatgcaaatgaacaggacacaaggcctgttactagcactcacatggaacaaatggcccagatcctggaggcttgctgaaggctgtatgctgaaatgctgcagactatgcacagttttggccactgactgactgtgcatactgcagcatttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 832 - DNA, 498 bp, Artificial sequence; identical to SEQ ID NO: 830
  Synthetic

SEQ ID NO: 833 - DNA, 363 bp, Artificial sequence
  Synthetic
atctgatcttctgaagaaaatatatttctttttattcatagctcttaactagtggtgatagcaatgtcagcagtgcctttaagaaacaaaataagtgtttgtgaagccacagatgaaacacttatcttgtttcttacaagtaaggttgaccatactctactctagagttgtgttttaatgtatattaatgttactaatgtgtttactagtggtgatagcaatgtcagcagtgccttatatatatatatatggcctttgtgaagccacagatgaaaggccatacatatatatatcaagtaaggttgaccatactctactctagtcagttttattgatagtcttttcagtattattgataatctt

SEQ ID NO: 834 - DNA, 363 bp, Artificial sequence
  Synthetic
atctgatcttctgaagaaaatatatttctttttattcatagctcttaactagtggtgatagcaatgtcagcagtgcctttatgtacaagccacttcctacgtgaagccacagatggtaggaagtgacttgtacatacaagtaaggttgaccatactctactctagagttgtgttttaatgtatattaatgttactaatgtgtttactagtggtgatagcaatgtcagcagtgccttaactttggagttccttctttagtgaagccacagatgtaaagaaggacctccaaagttcaagtaaggttgaccatactctactctagtcagttttattgatagtcttttcagtattattgataatctt

SEQ ID NO: 835 - DNA, 363 bp, Artificial sequence
  Synthetic
atctgatcttctgaagaaaatatatttctttttattcatagctcttaactagtggtgatagcaatgtcagcagtgcctttaagaaacaaaataagtgtttgtgaagccacagatgaaacacttatcttgtttcttacaagtaaggttgaccatactctactctagagttgtgttttaatgtatattaatgttactaatgtgtttactagtggtgatagcaatgtcagcagtgccttaactttggagttccttctttagtgaagccacagatgtaaagaaggacctccaaagttcaagtaaggttgaccatactctactctagtcagttttattgatagtcttttcagtattattgataatctt

SEQ ID NO: 836 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttatgtacaagccacttcctagttttggccactgactgactaggaagtcttgtacataacaggacacaaggcctgttactagcactcacatggaacaaatggcccagatcctggaggcttgctgaaggctgtatgctgatgccctgagatttcagtaacgttttggccactgactgacgttactgatctcagggcatcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 837 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgttatgtacaagccacttcctagttttggccactgactgactaggaagtcttgtacataacaggacacaaggcctgttactagcactcacatggaacaaatggcccagatcctggaggcttgctgaaggctgtatgctgtccttctttaattccagaggtgttttggccactgactgacacctctggttaaagaaggacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 838 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtgtcgagagagctttgcagaggttttggccactgactgacctctgcaactctctcgacacaggacacaaggcctgttactagcactcacatggaacaaatggcccagatcctggaggcttgctgaaggctgtatgctgatgccctgagatttcagtaacgttttggccactgactgacgttactgatctcagggcatcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 839 - DNA, 363 bp, Artificial sequence
  Synthetic
atctgatcttctgaagaaaatatatttctttttattcatagctcttaactagtggtgatagcaatgtcagcagtgccttttgacatcctgttgagcccaggtgaagccacagatgctgggctcaaaaggatgtcaacaagtaaggttgaccatactctactctagagttgtgttttaatgtatattaatgttactaatgtgtttactagtggtgatagcaatgtcagcagtgcctttaagacccaagcactaacatggtgaagccacagatgcatgttagtgattgggtcttacaagtaaggttgaccatactctactctagtcagttttattgatagtcttttcagtattattgataatctt

SEQ ID NO: 840 - DNA, 363 bp, Artificial sequence
  Synthetic
atctgatcttctgaagaaaatatatttctttttattcatagctcttaactagtggtgatagcaatgtcagcagtgcctttctaaagtaaaaattctcaaagtgaagccacagatgtttgagaattcttactttagacaagtaaggttgaccatactctactctagagttgtgttttaatgtatattaatgttactaatgtgtttactagtggtgatagcaatgtcagcagtgccttttccctacaagtctttccaatgtgaagccacagatgattggaaagaattgtagggaacaagtaaggttgaccatactctactctagtcagttttattgatagtcttttcagtattattgataatctt

SEQ ID NO: 841 - DNA, 363 bp, Artificial sequence
  Synthetic
atctgatcttctgaagaaaatatatttctttttattcatagctcttaactagtggtgatagcaatgtcagcagtgccttttgacatcctgttgagcccaggtgaagccacagatgctgggctcaaaaggatgtcaacaagtaaggttgaccatactctactctagagttgtgttttaatgtatattaatgttactaatgtgtttactagtggtgatagcaatgtcagcagtgccttttccctacaagtctttccaatgtgaagccacagatgattggaaagaattgtagggaacaagtaaggttgaccatactctactctagtcagttttattgatagtcttttcagtattattgataatctt

SEQ ID NO: 842 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtttcttgccagtcttgagttcgttttggccactgactgacgaactcaactggcaagaaacaggacacaaggcctgttactagcactcacatggaacaaatggcccagatcctggaggcttgctgaaggctgtatgctgtcctatggacccttaagacccgttttggccactgactgacgggtcttaggtccataggacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 843 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtatggatgcatattctgttgggttttggccactgactgacccaacagaatgcatccatacaggacacaaggcctgttactagcactcacatggaacaaatggcccagatcctggaggcttgctgaaggctgtatgctgaatgatgtcaacatgctgatcgttttggccactgactgacccaacagaatgcatccatacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 844 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtttcttgccagtcttgagttcgttttggccactgactgacgaactcaactggcaagaaacaggacacaaggcctgttactagcactcacatggaacaaatggcccagatcctggaggcttgctgaaggctgtatgctgaatgatgtcaacatgctgatcgttttggccactgactgacgatcagcattgacatcattcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 845 - DNA, 363 bp, Artificial sequence
  Synthetic
atctgatcttctgaagaaaatatatttctttttattcatagctcttaactagtggtgatagcaatgtcagcagtgcctaaggatgagaaacagcaggagggtgaagccacagatgcctcctgctgcttctcatcctcaagtaaggttgaccatactctactctagagttgtgttttaatgtatattaatgttactaatgtgtttactagtggtgatagcaatgtcagcagtgccttatcttgctctgagcctgcggagtgaagccacagatgtccgcaggctaagagcaagatcaagtaaggttgaccatactctactctagtcagttttattgatagtcttttcagtattattgataatctt

SEQ ID NO: 846 - DNA, 363 bp, Artificial sequence
  Synthetic
atctgatcttctgaagaaaatatatttctttttattcatagctcttaactagtggtgatagcaatgtcagcagtgcctttggtcgccactgtcttctccagtgaagccacagatgtggagaagaccgtggcgaccacaagtaaggttgaccatactctactctagagttgtgttttaatgtatattaatgttactaatgtgtttactagtggtgatagcaatgtcagcagtgccttccaggtcagagctgctccggcgtgaagccacagatggccggagcagatctgacctggcaagtaaggttgaccatactctactctagtcagttttattgatagtcttttcagtattattgataatctt

SEQ ID NO: 847 - DNA, 363 bp, Artificial sequence
  Synthetic
atctgatcttctgaagaaaatatatttctttttattcatagctcttaactagtggtgatagcaatgtcagcagtgcctttggtcgccactgtcttctccagtgaagccacagatgtggagaagaccgtggcgaccacaagtaaggttgaccatactctactctagagttgtgttttaatgtatattaatgttactaatgtgtttactagtggtgatagcaatgtcagcagtgccttatcttgctctgagcctgcggagtgaagccacagatgtccgcaggctaagagcaagatcaagtaaggttgaccatactctactctagtcagttttattgatagtcttttcagtattattgataatctt

SEQ ID NO: 848 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgctagacagctctgtgaagtacgttttggccactgactgacgtacttcagagctgtctagcaggacacaaggcctgttactagcactcacatggaacaaatggcccagatcctggaggcttgctgaaggctgtatgctgttcttgctccagctcctctatgttttggccactgactgacatagaggatggagcaagaacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 849 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgatgagaaacagcaggaggtgggttttggccactgactgacccacctccctgtttctcatcaggacacaaggcctgttactagcactcacatggaacaaatggcccagatcctggaggcttgctgaaggctgtatgctgaaaggtgaaagccaaaggctcgttttggccactgactgacgagcctttctttcacctttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 850 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgctagacagctctgtgaagtacgttttggccactgactgacgtacttcagagctgtctagcaggacacaaggcctgttactagcactcacatggaacaaatggcccagatcctggaggcttgctgaaggctgtatgctgaaaggtgaaagccaaaggctcgttttggccactgactgacgagcctttctttcacctttcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 851 - DNA, 363 bp, Artificial sequence
  Synthetic
atctgatcttctgaagaaaatatatttctttttattcatagctcttaactagtggtgatagcaatgtcagcagtgccttgtatcttccagaagatgcctcgtgaagccacagatggaggcatcttatggaagataccaagtaaggttgaccatactctactctagagttgtgttttaatgtatattaatgttactaatgtgtttactagtggtgatagcaatgtcagcagtgccttatattcatctataatagcaaagtgaagccacagatgtttgctattacagatgaatatcaagtaaggttgaccatactctactctagtcagttttattgatagtcttttcagtattattgataatctt

SEQ ID NO: 852 - DNA, 363 bp, Artificial sequence
  Synthetic
atctgatcttctgaagaaaatatatttctttttattcatagctcttaactagtggtgatagcaatgtcagcagtgccttgtatcttccagaagatgcctcgtgaagccacagatggaggcatcttatggaagataccaagtaaggttgaccatactctactctagagttgtgttttaatgtatattaatgttactaatgtgtttactagtggtgatagcaatgtcagcagtgccttacacacacacacacacacgcagtgaagccacagatgtgcgtgtgtgcgtgtgtgtgtcaagtaaggttgaccatactctactctagtcagttttattgatagtcttttcagtattattgataatctt

SEQ ID NO: 853 - DNA, 363 bp, Artificial sequence
  Synthetic
atctgatcttctgaagaaaatatatttctttttattcatagctcttaactagtggtgatagcaatgtcagcagtgccttatattcatctataatagcaaagtgaagccacagatgtttgctattacagatgaatatcaagtaaggttgaccatactctactctagagttgtgttttaatgtatattaatgttactaatgtgtttactagtggtgatagcaatgtcagcagtgccttacacacacacacacacacgcagtgaagccacagatgtgcgtgtgtgcgtgtgtgtgtcaagtaaggttgaccatactctactctagtcagttttattgatagtcttttcagtattattgataatctt

SEQ ID NO: 854 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtgtatcttccagaagatgcctgttttggccactgactgacaggcatcttggaagatacacaggacacaaggcctgttactagcactcacatggaacaaatggcccagatcctggaggcttgctgaaggctgtatgctgcttacttataacctgcctttggttttggccactgactgaccaaaggcattataagtaagcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 855 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgaagtgtatcttccagaagatggttttggccactgactgaccatcttctaagatacacttcaggacacaaggcctgttactagcactcacatggaacaaatggcccagatcctggaggcttgctgaaggctgtatgctgcttacttataacctgcctttggttttggccactgactgaccaaaggcattataagtaagcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 856 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgcttacttataacctgcctttggttttggccactgactgaccaaaggcattataagtaagcaggacacaaggcctgttactagcactcacatggaacaaatggcccagatcctggaggcttgctgaaggctgtatgctgttaactgtaagttcttgaggggttttggccactgactgacccctcaagcttacagttaacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 857 - DNA, 363 bp, Artificial sequence
  Synthetic
atctgatcttctgaagaaaatatatttctttttattcatagctcttaactagtggtgatagcaatgtcagcagtgccttagaattataaagaagatcatggtgaagccacagatgcatgatcttccttataattctcaagtaaggttgaccatactctactctagagttgtgttttaatgtatattaatgttactaatgtgtttactagtggtgatagcaatgtcagcagtgcctttaactatcttaacaagctttggtgaagccacagatgcaaagcttgtcaagatagttacaagtaaggttgaccatactctactctagtcagttttattgatagtcttttcagtattattgataatctt

SEQ ID NO: 858 - DNA, 363 bp, Artificial sequence
  Synthetic
atctgatcttctgaagaaaatatatttctttttattcatagctcttaactagtggtgatagcaatgtcagcagtgcctttaactatcttaacaagctttggtgaagccacagatgcaaagcttgtcaagatagttacaagtaaggttgaccatactctactctagagttgtgttttaatgtatattaatgttactaatgtgtttactagtggtgatagcaatgtcagcagtgcctttcattataacaaatttccaatgtgaagccacagatgattggaaattcgttataatgacaagtaaggttgaccatactctactctagtcagttttattgatagtcttttcagtattattgataatctt

SEQ ID NO: 859 - DNA, 363 bp, Artificial sequence
  Synthetic
atctgatcttctgaagaaaatatatttctttttattcatagctcttaactagtggtgatagcaatgtcagcagtgcctttaactatcttaacaagctttggtgaagccacagatgcaaagcttgtcaagatagttacaagtaaggttgaccatactctactctagagttgtgttttaatgtatattaatgttactaatgtgtttactagtggtgatagcaatgtcagcagtgccttaagaagtaaatatgaatcttagtgaagccacagatgtaagattcatctttacttcttcaagtaaggttgaccatactctactctagtcagttttattgatagtcttttcagtattattgataatctt

SEQ ID NO: 860 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtaagttgccagccctcctagagttttggccactgactgactctaggagctggcaacttacaggacacaaggcctgttactagcactcacatggaacaaatggcccagatcctggaggcttgctgaaggctgtatgctgttaaccacaaccatgccttacgttttggccactgactgacgtaaggcagttgtggttaacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 861 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtccaaatgcggcatcttcaaagttttggccactgactgactttgaagaccgcatttggacaggacacaaggcctgttactagcactcacatggaacaaatggcccagatcctggaggcttgctgaaggctgtatgctgtaagttgccagccctcctagagttttggccactgactgactctaggagctggcaacttacaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 862 - DNA, 498 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgtccaaatgcggcatcttcaaagttttggccactgactgactttgaagaccgcatttggacaggacacaaggcctgttactagcactcacatggaacaaatggcccagatcctggaggcttgctgaaggctgtatgctgcaaacatggagacagcactcagttttggccactgactgactgagtgctctccatgtttgcaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 863 - DNA, 999 bp, Artificial sequence
  Synthetic
atctgatcttctgaagaaaatatatttctttttattcatagctcttaactagtggtgatagcaatgtcagcagtgcctaatcttaatcataaattcgggtgtgaagccacagatgacccgaatttctgattaagatcaagtaaggttgaccatactctactctagttatattctttaggcacgaatgtgtgtttaaaaaaaataaaaactagtggtgatagcaatgtcagcagtgcctttctccaggacctagagcccaagtgaagccacagatgttgggctctaagtcctggagacaagtaaggttgaccatactctactctagagttgtgttttaatgtatattaatgttactaatgtgtttactagtggtgatagcaatgtcagcagtgccttagaagctcctaactccacttcgtgaagccacagatggaagtggagtcaggagcttctcaagtaaggttgaccatactctactctaggttatttttagtatgattctgtaaaaatgaattaatactaactagtggtgatagcaatgtcagcagtgccttagggggatatctattgggatggtgaagccacagatgcatcccaataaatatccccctcaagtaaggttgaccatactctactctagatttttcagatgtatcatctcttaaaatactgtaattgcaactagtggtgatagcaatgtcagcagtgccttggttttggagctagcctctgggtgaagccacagatgccagaggctaactccaaaacccaagtaaggttgaccatactctactctagttatattctttaggcacgaatgtgtgtttaaaaaaaataaaaactagtggtgatagcaatgtcagcagtgccttagcctatttcgtacttggggggtgaagccacagatgcccccaagtaagaaataggctcaagtaaggttgaccatactctactctagtcagttttattgatagtcttttcagtattattgataatctt

SEQ ID NO: 864 - DNA, 999 bp, Artificial sequence
  Synthetic
atctgatcttctgaagaaaatatatttctttttattcatagctcttaactagtggtgatagcaatgtcagcagtgccttgaagatccatcatctgtgggagtgaagccacagatgtcccacagataatggatcttccaagtaaggttgaccatactctactctagttatattctttaggcacgaatgtgtgtttaaaaaaaataaaaactagtggtgatagcaatgtcagcagtgccttatttctttatgaacactattagtgaagccacagatgtaatagtgttaataaagaaatcaagtaaggttgaccatactctactctagagttgtgttttaatgtatattaatgttactaatgtgtttactagtggtgatagcaatgtcagcagtgccttgtgtattgaaccatgacgggtgtgaagccacagatgacccgtcatgattcaatacaccaagtaaggttgaccatactctactctaggttatttttagtatgattctgtaaaaatgaattaatactaactagtggtgatagcaatgtcagcagtgccttttagtcacttaggcatgctaagtgaagccacagatgttagcatgcataagtgactacaaagtaaggttgaccatactctactctagatttttcagatgtatcatctcttaaaatactgtaattgcaactagtggtgatagcaatgtcagcagtgccttggttttggagctagcctctgggtgaagccacagatgccagaggctaactccaaaacccaagtaaggttgaccatactctactctagttatattctttaggcacgaatgtgtgtttaaaaaaaataaaaactagtggtgatagcaatgtcagcagtgccttaagtaggagatgagaagcagagtgaagccacagatgtctgcttctcctctcctacttcaagtaaggttgaccatactctactctagtcagttttattgatagtcttttcagtattattgataatctt

SEQ ID NO: 865 - DNA, 999 bp, Artificial sequence
  Synthetic
atctgatcttctgaagaaaatatatttctttttattcatagctcttaactagtggtgatagcaatgtcagcagtgcctaatcttaatcataaattcgggtgtgaagccacagatgacccgaatttctgattaagatcaagtaaggttgaccatactctactctagttatattctttaggcacgaatgtgtgtttaaaaaaaataaaaactagtggtgatagcaatgtcagcagtgccttatttctttatgaacactattagtgaagccacagatgtaatagtgttaataaagaaatcaagtaaggttgaccatactctactctagagttgtgttttaatgtatattaatgttactaatgtgtttactagtggtgatagcaatgtcagcagtgccttagaagctcctaactccacttcgtgaagccacagatggaagtggagtcaggagcttctcaagtaaggttgaccatactctactctaggttatttttagtatgattctgtaaaaatgaattaatactaactagtggtgatagcaatgtcagcagtgccttttagtcacttaggcatgctaagtgaagccacagatgttagcatgcataagtgactacaaagtaaggttgaccatactctactctagatttttcagatgtatcatctcttaaaatactgtaattgcaactagtggtgatagcaatgtcagcagtgccttttaggaacacagattgggagcgtgaagccacagatggctcccaatccgtgttcctaacaagtaaggttgaccatactctactctagttatattctttaggcacgaatgtgtgtttaaaaaaaataaaaactagtggtgatagcaatgtcagcagtgccttagcctatttcgtacttggggggtgaagccacagatgcccccaagtaagaaataggctcaagtaaggttgaccatactctactctagtcagttttattgatagtcttttcagtattattgataatctt

SEQ ID NO: 866 - DNA, 1095 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgagtgtttggcagctcttcagcgttttggccactgactgacgctgaagatgccaaacactcaggacacaaggcctgttactagcactcacatggaacaaatggcccagatcctggaggcttgctgaaggctgtatgctgaacattctccaggacctagaggttttggccactgactgacctctaggttggagaatgttcaggacacaaggcctgttactagcactcacatggaacaaatggcccagatcctggaggcttgctgaaggctgtatgctgagaagctcctaactccacttcgttttggccactgactgacgaagtggataggagcttctcaggacacaaggcctgttactagcactcacatggaacaaatggcccagatcctggaggcttgctgaaggctgtatgctgatatctattgggatgcagagagttttggccactgactgactctctgcaccaatagatatcaggacacaaggcctgttactagcactcacatggaacaaatggcccagatcctggaggcttgctgaaggctgtatgctgtgaggatgaagaatgacctgggttttggccactgactgacccaggtcacttcatcctcacaggacacaaggcctgttactagcactcacatggaacaaatggcccagatcctggaggcttgctgaaggctgtatgctgtggtttagcctatttcgtactgttttggccactgactgacagtacgaaaggctaaaccacaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 867 - DNA, 1095 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgaacattctccaggacctagaggttttggccactgactgacctctaggttggagaatgttcaggacacaaggcctgttactagcactcacatggaacaaatggcccagatcctggaggcttgctgaaggctgtatgctgatcggcagcaggacatacaacgttttggccactgactgacgttgtatgctgctgccgatcaggacacaaggcctgttactagcactcacatggaacaaatggcccagatcctggaggcttgctgaaggctgtatgctgtattgaaccatgacgggttaggttttggccactgactgacctaacccgatggttcaatacaggacacaaggcctgttactagcactcacatggaacaaatggcccagatcctggaggcttgctgaaggctgtatgctgtagtcacttaggcatgctaaggttttggccactgactgaccttagcatctaagtgactacaggacacaaggcctgttactagcactcacatggaacaaatggcccagatcctggaggcttgctgaaggctgtatgctgtgaggatgaagaatgacctgggttttggccactgactgacccaggtcacttcatcctcacaggacacaaggcctgttactagcactcacatggaacaaatggcccagatcctggaggcttgctgaaggctgtatgctgatgagaagcagagtgagaatcgttttggccactgactgacgattctcactgcttctcatcaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 868 - DNA, 1095 bp, Artificial sequence
  Synthetic
aattcacagactttcctcatgaaaccagctcatctgagaaaacagcaaagtttaaaaaagaaatactatcagtgctgcaaaccaggaaggggaagtgtgtggtttaagttgcatatcccttatcctctggctgctggaggcttgctgaaggctgtatgctgagtgtttggcagctcttcagcgttttggccactgactgacgctgaagatgccaaacactcaggacacaaggcctgttactagcactcacatggaacaaatggcccagatcctggaggcttgctgaaggctgtatgctgatcggcagcaggacatacaacgttttggccactgactgacgttgtatgctgctgccgatcaggacacaaggcctgttactagcactcacatggaacaaatggcccagatcctggaggcttgctgaaggctgtatgctgagaagctcctaactccacttcgttttggccactgactgacgaagtggataggagcttctcaggacacaaggcctgttactagcactcacatggaacaaatggcccagatcctggaggcttgctgaaggctgtatgctgtagtcacttaggcatgctaaggttttggccactgactgaccttagcatctaagtgactacaggacacaaggcctgttactagcactcacatggaacaaatggcccagatcctggaggcttgctgaaggctgtatgctgattgggagcaggtacaggagagttttggccactgactgactctcctgtctgctcccaatcaggacacaaggcctgttactagcactcacatggaacaaatggcccagatcctggaggcttgctgaaggctgtatgctgtggtttagcctatttcgtactgttttggccactgactgacagtacgaaaggctaaaccacaggacacaaggcctgttactagcactcacatggaacaaatggcccaggacacaaggcctgttactagcactcacatggaacaaatggccaccgtgggaggatgacaagtccaagagtcaccctgctggatgaacgtagatgtcagactctatcatttaatgtgctagtcataacctggttacta

SEQ ID NO: 869 - protein, 450 aa, Artificial sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 870 - protein, 214 aa, Artificial sequence
  Synthetic
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 871 - protein, 451 aa, Artificial sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 872 - protein, 450 aa, Artificial sequence
  Synthetic
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 873 - DNA, 9736 bp, Artificial sequence
  Synthetic
atgaagtgggtaacatttattagcctgttgtttctgttttcatcggcttattccgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaaggttaatcgagtacgatagccggctaatcagccataccacatttgtagaggttttacttgctttaaaaaacctcccacacctccccctgaacctgaaacataaaatgaatgcaattgttgttgttaacttgtttattgcagcttataatggttacaaataaagcaatagcatcacaaatttcacaaataaagcatttttttcactgcattctagttgtggtttgtccaaactcatcaatgtatcttatcatgtctggaattcggacggtgactgcagtgaataataaaatgtgtgtttgtccgaaatacgcgttttgagatttctgtcgccgactaaattcatgtcgcgcgatagtggtgtttatcgccgatagagatggcgatattggaaaaatcgatatttgaaaatatggcatattgaaaatgtcgccgatgtgagtttctgtgtaactgatatcgccatttttccaaaagtgatttttgggcatacgcgatatctggcgatagcgcttatatcgtttacgggggatggcgatagacgactttggtgacttgggcgattctgtgtgtcgcaaatatcgcagtttcgatataggtgacagacgatatgaggctatatcgccgatagaggcgacatcaagctggcacatggccaatgcatatcgatctatacattgaatcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgacgtaagtaccgcctatagagtctataggcccacccccttggcttcttatgcatgctatactgtttttggcttggggtctatacacccccgcttcctcatgttataggtgatggtatagcttagcctataggtgtgggttattgaccattattgaccactcccctattggtgacgatactttccattactaatccataacatggctctttgccacaactctctttattggctatatgccaatacactgtccttcagagactgacacggactctgtatttttacaggatgggttctcatttattatttacaaattcacatatacaacaccaccgtccccagtgcccgcagtttttattaaacataacgtgggatctccacgcgaatctcgggtacgtgttccggacatgggttcttctccggtagcggcggagcttctacatccgagccctgctcccatgcctccagcgactcatggtcgctcggcagctccttgctcctaacagtggaggccagacttaggcacagcacgatgcccaccaccaccagtgtgccgcacaaggccgtggcggtagggtatgtgtctgaaaatgagctcggggagcgggcttgcaccgctgacgcatttgaaagacttaaggcagcggcagaagaagatgcaggcagctgagttgttgtgttctgataagagtcagaggtaactcccgttgcggtgctgttaacggtggagggcagtgtagtctgagcagtactcgttgctgccgcgcgcgccaccagacataatagctgacagactaacagactgttcctttccatgggtcttttctgcagtcaccgtccttgacacgaagtttgctcgagccaccatgaaaactcactactcgagcgccattctgccgatcctgaccctcttcgtgttcctgtccatcaacccctcccatggagaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggacgaactgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaaaaaattgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattggcaagacaatagcaggctttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgaccaaaacggctggcagtaaaagggttaagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctgtgtggtaagcaggtcttaacctttttactgccaatgacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtctttctttatgttttgtggtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattatcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtactggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgtggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacaggagtgccttaaatttgtctctgcaggcttccggttgtacttgaaaacttcacagaacaccagcttgttgggctcccggcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaggtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtccgccccctattgacgtcaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcggccgggaacggtgcattggaacgcggattccccgtgccaagagtgaccctggcagaactcggtaagtctgttgacatgtatgtgatgtatactaacctgcatgggacgtggatttacttgtgtatgtcagatagagtaaagattaactcttgcatgtgagcggggcatcgagatagcgataaatgagtcaggaggacggatacttatatgtgttgttatcctcctctacagtcaaacagattaagcgtctcaggggagcttccttcttctttttcctagaagctcagaataaacgctcaactttggccgccacc

SEQ ID NO: 874 - DNA, 13142 bp, Artificial sequence
  Synthetic
atgggagtgaaggtcctgttcgcactgatttgcatcgccgtggcggaagccgaagtgcaacttgtggaatcggggggaggtttggtgcaacctggaggatcattgagactgtcatgtgcagcctcgggattcaatatcaaggacacttacatccactgggtgcggcaggctccgggaaagggcctggaatgggtggcccggatctaccccaccaacggctacactcgctacgctgactccgtgaagggacgcttcactattagcgcggatacctccaagaacaccgcctacttgcaaatgaactccctccgggccgaggacaccgccgtctactactgctcgcgatgggggggagatggcttctacgcgatggactactggggccaggggacgctcgtcactgtgtcgagcgcatccactaaggggcctagcgtctttccgctggccccgtcctccaagtccacttcgggtggaaccgcggcactggggtgcctcgtgaaggactacttccccgagccggtcaccgtgtcctggaactcgggagccctgacctccggagtgcatactttccctgcggtgctgcagtcctccgggctctactcgctgtcaagcgtggtcaccgtcccgagctcatccctgggtactcagacctacatttgcaacgtgaaccacaaaccttccaacaccaaggtcgacaagaaagtggagcctaagagctgcgacaagacccacacctgtcccccgtgtcccgcccctgagctgctgggcggccccagcgtgttcctcttcccgcctaagccgaaggacactctgatgatctcgagaacccctgaagtgacctgtgtggtggtggatgtgtcccacgaggatccggaagtgaagttcaattggtacgtggacggagtggaagtccataacgccaagaccaagccccgcgaggaacagtacaactcaacttaccgggtggtgtcagtgctgaccgtgctgcaccaagattggctgaacgggaaggagtacaagtgcaaagtctccaacaaggcgctgccggcccccattgaaaagaccatcagcaaggctaagggccagccccgggaaccacaggtctacaccttgcccccttcccgggaggaaatgaccaagaaccaagtgtcgctgacgtgcctggtcaagggcttttatccatctgacatcgccgtggagtgggaaagcaacggccagccggaaaacaactacaagactaccccgcctgtgctggactccgacggctcgttcttcctgtattccaagctcaccgtggataagtccagatggcagcagggcaatgtgttcagctgcagcgtgatgcatgaggccctgcacaaccactacactcagaaatcactgtccctttcccccggaaagtaatgaggtatcgggggaggctaactgaaacacggaaggagacaataccggaaggaacccgcgctatgacggcaataaaaagacagaataaaacgcacgggtgttgggtcgtttgttcataaacgcggggttcggtcccagggctggcactctgtcgataccccaccgagtccccattggggccaatacgcccgcgtttcttccttttccccaccccaccccccaagttcgggtgaaggcccagggctcgcagccaacgtcggggcggcaggccctgccatagaaatcgataatatatggtagggttcatagccagagtaacctttttttttaatttttattttattttatttttgagtcgggcgcgccaaaatgaagtgaagttcctatactttctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacaggcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagcttgaaacttgatctgtcgccgcaattcaagcttcgtgaggctccggtgcccgtcagtgacctgctatactctggagacgagcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgttctttttcgcaacgggtttgccgtcagaacgcaggtgaggggcgggtgtggcttccgcgggccgccgagctggaggtcctgctccgagcgggccgggccccgctgtcgtcggcggggattagctgcgagcattcccgcttcgagttgcgggcggcgcgggaggcagagtgcgaggcctagcggcaaccccgtagcctcgcctcgtgtccggcttgaggcctagcgtggtgtccgcgccgccgccgcgtgctactccggccgcactctggtctttttttttttgttgttgttgccctgctgccttcgattgccgttcagcaataggggctaacaaagggagggtgcggggcttgctcgcccggagcccggagaggtcatggttggggaggaatggagggacaggagtggcggctggggcccgcccgccttcggagcacatgtccgacgccacctggatggggcgaggcctggggtttttcccgaagcaaccaggctggggttagcgtgccgaggccatgtggccccagcacccggcacgatctggcttggcggcgccgcgttgccctgcctccctaactagggtgaggccatcccgtccggcaccagttgcgtgcgtggaaagatggccgctcccgggccctgttgcaaggagctcaaaatggaggacgcggcagcccggtggagcgggcgggtgagtcacccacacaaaggaagagggcctggtccctcaccggctgctgcttcctgtgaccccgtggtcctatcggccgcaatagtcacctcgggcttttgagcacggctagtcgcggcggggggaggggatgtaatggcgttggagtttgttcacatttggtgggtggagactagtcaggccagcctggcgctggaagtcatttttggaatttgtccccttgagttttgagcggagctaattctcgggcttcttagcggttcaaaggtatcttttaaacccttttttaggtgttgtgaaaaccaccgctaattcaaagcaagccgccaccatggacatgagggtccccgctcagctcctggggctcctgctgctctggctcccaggtgccaaatgtgatattcagatgacccaatccccctcctcattgagcgcgtccgtcggagacagagtgaccattacttgtcgcgcctcccaagacgtgaacaccgctgtggcttggtaccagcagaagccgggaaaggcccctaagctgctgatctactctgcctccttcctgtactcgggcgtgccgagccggttcagcgggagccggtcgggaaccgatttcactctgaccatctcgtcactgcaacccgaggactttgccacctactactgccagcagcactacaccactccaccgaccttcggacaaggcaccaaggtcgaaatcaagcgcaccgtggccgcccctagcgtgtttatcttccctccctcggatgagcagcttaagtcaggcaccgcatccgtggtctgcctgctcaacaacttctacccgagggaagccaaagtgcagtggaaagtggacaacgcgctccagtcgggaaactcccaggagtccgtgaccgaacaggactccaaggacagcacttattccctgtcctccactctgacgctgtcaaaggccgactacgagaagcacaaggtctacgcctgcgaagtgacccatcaggggctttcctcgcccgtgactaagagcttcaatcggggcgaatgctaataaaagcttaattaatggctaataaaggaaatttattttcattgcaatagtgtgttggaattttttgtgtctctcactcggaagaacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggtttgcatttttagacatttagaagcctatatcttgttacagaattggaattacacaaaaattctaccatattttgaaagcttaggttgttctgaaaaaaacaatatattgttttcctgggtaaactaaaagtcccctcgaggaaaggcccctaaagtgaaacagtgcaaaacgttcaaaaactgtctggcaatacaagttccactttgggacaaatcggctggcagtgaaagggttaagcggccgctcagccttgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtgggctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgacgcgcgcgtaactcacgttaagggattttggtcatgagttagaaaaactcatcgagcatcaaatgaaactgcaatttattcatatcaggattatcaataccatatttttgaaaaagccgtttctgtaatgaaggagaaaactcaccgaggcagttccataggatggcaagatcctggtatcggtctgcgattccgactcgtccaacatcaatacaacctattaatttcccctcgtcaaaaataaggttatcaagtgagaaatcaccatgagtgacgactgaatccggtgagaatggcaaaagtttatgcatttctttccagacttgttcaacaggccagccattacgctcgtcatcaaaatcactcgcatcaaccaaaccgttattcattcgtgattgcgcctgagcgaggcgaaatacgcgatcgctgttaaaaggacaattacaaacaggaatcgagtgcaaccggcgcaggaacactgccagcgcatcaacaatattttcacctgaatcaggatattcttctaatacctggaacgctgtttttccggggatcgcagtggtgagtaaccatgcatcatcaggagtacggataaaatgcttgatggtcggaagtggcataaattccgtcagccagtttagtctgaccatctcatctgtaacatcattggcaacgctacctttgccatgtttcagaaacaactctggcgcatcgggcttcccatacaagcgatagattgtcgcacctgattgcccgacattatcgcgagcccatttatacccatataaatcagcatccatgttggaatttaatcgcggcctcgacgtttcccgttggatatggctcattttttacttcctcaccttgtcgtattatactatgccgatatactatgccgatgattaattgtcgacactgcgggggctctggcgcgccttaaccctttgcctgccaatcacgcatgggatacgtcgtggcagtaaaagggcttaaatgccaacgacgcgtcccatacgttgttggcattttaattcttctctctgcagcggcagcatgtgccgccgctgcagagagtttctagcgatgacagcccctctgggcaacgagccgggggggctgtcgctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagaggagtagaatgttgagagtcagcagtagcctcatcatcactagatggcatttcttctgagcaaaacaggttttcctcattaaaggcattccaccactgctcccattcatcagttccataggttggaatctaaaatacacaaacaattagaatcagtagtttaacacattatacacttaaaaattttatatttaccttagagctttaaatctctgtaggtagtttgtccaattatgtcacaccacagaagtaaggttccttcacaaagatctctctggggcggggtgggatgaactaggaaaggctcaagatcactcaaagtctaattatcactgcattctagttgtggtttgtccaaactcatcaatgtatcttatcatgtctgagcggatccagtttttgtattggaagggctcgtcgccagtctcattgagaaggcatgtgcggacgatggcttctgtcactgcaaaggggtcacaattggcagaggggcggcgatcttcaaagtaacctttcttctcctggccgacagtccggggaatgcggatgctggcactgcgattggcgacaccagcagaaaagtcgttgatgttggacgtttcgtggaacccagtcagacgacgggcattgtccaggccccccttgggatcgtaggctcgaatgtggtactggtgccgcttgcttagtttctcgatggcctcctcgatgtgcttcagaccattctcctcccgcatggccttggtgctaaagttggtatggcagcctgcaccattccagttcccaggaatgggcttggggtcaaaggttgctattaccccaaagtcctcacatactcgatgcaagatgaaacgggccacccagagatgatctcccatgtggattccttcacagggtcctatttggaactcccactgggcaggcatgacctcagcatttgttcctgtaatcttgaccccagcatacaagcaggcgcggtagtgagcctccacgatatccctgccataggctttgtctgcgcccacaccacagtaatacggaccttggggcccaggaaagccattggaaggccaaccaaaagggtgcccatctgttcccatcagagtatactcctgttccattccaaaccaggggtgctggttgctcaccatgtccattatccgtttacaggagtgccttaaatttgtctctgcaggcttccggttgtacttgaaaacttcacagaacaccagcttgttgggctcccggcggaaggggtcccgaaacatggcaacagggctgagatacatgtcactgttggagccctcagactgaaaggtactagagccatcaaaattccactcaggtaactcttctacacacttgggctcacagtccagggtgcgggttttgcagcgcagtccttctccagtaccatcaacccagatatacatggcttggactttctcaccctggggcaggcacaggtacatttgcttgatgtttttgttcaagtgggaacttgctgaggtggccatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggcagcttgcttgttctttttgcagaagctcagaataaacgctcaactttggccgccacc

SEQ ID NO: 875 - protein, 124 aa, Artificial sequence
  Synthetic
MAKLTSAVPVLTARDVAGAVEFWTDRLGFSRDFVEDDFAGVVRDDVTLFISAVQDQVVPDNTLAWVWVRGLDELYAEWSEVVSTNFRDASGPAMTEIGEQPWGREFALRDPAGNCVHFVAEEQD

SEQ ID NO: 876 - protein, 152 aa, Artificial sequence
  Synthetic
MVAISKNGVIGNGPDIPWSAKGEQLLFKAITYNQWLLVGRKTFESMGALPNRKYAVVTRSSFTSDNEDVLIFPSIKDALTNLKKITDHVIVSGGGEIYKSLIDQVDTLHISTIDIEPEGDVYFPEIPSNFRPVFTQDFASNINYSYQIWQKG

SEQ ID NO: 877 - protein, 187 aa, Artificial sequence
  Synthetic
MVRPLNCIVAVSQNMGIGKNGDLPWPPLRNEFKYFQRMTTTSSVEGKQNLVIMGRKTWFSIPEKNRPLKDRINIVLSRELKEPPRGAHFLAKSLDDALRLIEQPELASKVDMVWIVGGSSVYQEAMNQPGHLRLFVTRIMQEFESDTFFPEIDLGKYKLLPEYPGVLSEVQEEKGIKYKFEVYEKKD

SEQ ID NO: 878 - protein, 264 aa, Artificial sequence
  Synthetic
MIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKASMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 879 - protein, 267 aa, Artificial sequence
  Synthetic
MGSAIEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGDDLVVTHGDACLPNIMVENGRFSGFIDCGRLGVADRYQDIALATRDIAEELGGEWADRFLVLYGIAAPDSQRIAFYRLLDEFF

SEQ ID NO: 880 - protein, 264 aa, Artificial sequence [sequence omitted]

SEQ ID NO: 881 - protein, 264 aa, Artificial sequence
  Synthetic
MVEQDGLHAGSPAAWVERLFGYDWAQQTIGCSDAAVFRLSAQGRPVLFVKTDLSGALNELQDEAARLSWLATTGVPCAAVLDVVTEAGRDWLLLGEVPGQDLLSSHLAPAEKVSIMADAMRRLHTLDPATCPFDHQAKHRIERARTRMEAGLVDQDDLDEEHQGLAPAELFARLKARMPDGEDLVVTHGDACLPNIMVENGRFSGFIDCGRLGVADRYQDIALATRDIAEELGGEWADRFLVLYGIAAPDSQRIAFYRLLDEFF

SEQ ID NO: 882 - protein, 341 aa, Artificial sequence
  Synthetic
MDRSGKPELTATSVEKFLIEKFDSVSDLMQLSEGEESRAFSFDVGGRGYVLRVNSCADGFYKDRYVYRHFASAALPIPEVLDIGEFSESLTYCISRRAQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPR

SEQ ID NO: 883 - protein, 341 aa, Artificial sequence
  Synthetic
MKKPELTATSVEKFLIEKFDSVSDLMQLSEGEESRAFSFDVGGRGYVLRVNSCADGFYKDRYVYRHFASAALPIPEVLDIGEFSESLTYCISRRAQGVTLQDLPETELPAVLQPVAEAMDAIAAADLSQTSGFGPFGPQGIGQYTTWRDFICAIADPHVYHWQTVMDDTVSASVAQALDELMLWAEDCPEVRHLVHADFGSNNVLTDNGRITAVIDWSEAMFGDSQYEVANIFFWRPWLACMEQQTRYFERRHPELAGSPRLRAYMLRIGLDQLYQSLVDGNFDDAAWAQGRCDAIVRSGAGTVGRTQIARRSAAVWTDGCVEVLADSGNRRPSTRPRAKE

SEQ ID NO: 884 - protein, 199 aa, Artificial sequence
  Synthetic
MTEYKPTVRLATRDDVPRAVRTLAAAFADYPATRHTVDPDRHIERVTRAARTLPHARRARHRQGVGRATRRRGGGLDHAGERRSGGGVRRDRNAHGRVERFPAGRAATDGRPPGAAPAQGARVVPGHRRRLARPPGQGSGQRRRAPRSGGGRARRGARLPGDLRAPQPPFYERLGFTVTADVECPKDRATWCMTRKPGA

SEQ ID NO: 885 - protein, 199 aa, Artificial sequence
  Synthetic
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVECPKDRATWCMTRKPGA

SEQ ID NO: 886 - protein, 199 aa, Artificial sequence
  Synthetic
MTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 887 - protein, 132 aa, Artificial sequence
  Synthetic
MAKPLSQEESTLIERATATINSIPISEDYSVASAALSSDGRIFTGVNVYHFTGGPCAELVVLGTAAAAAAGNLTCIVAIGNENRGILSPCGRCRQVLLDLHPGIKAIVKDSDGQPTAVGIRELLPSGYVWEG

SEQ ID NO: 888 - protein, 373 aa, Artificial sequence
  Synthetic
MATSASSHLNKNIKQMYLCLPQGEKVQAMYIWVDGTGEGLRCKTRTLDCEPKCVEELPEWNFDGSSTFQSEGSNSDMYLSPVAMFRDPFRRDPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWVARFILHRVCEDFGVIATFDPKPIPGNWNGAGCHTNFSTKAMREENGLKHIEEAIEKLSKRHRYHIRAYDPKGGLDNARRLTGFHETSNINDFSAGVANRSASIRIPRTVGQEKKGYFEDRRPSANCDPFAVTEAIVRTCLLNETGDEPFQYKN

SEQ ID NO: 889 - protein, 373 aa, Artificial sequence
  Synthetic
MATSASSHLNKGIKQMYMNLPQGEKIQLMYIWVDGTGEGLRCKTRTLDCDPKCVEELPEWNFDGSSTFQSEGSNSDMYLHPVAMFRDPFRRDPNKLVFCEVFKYNRKPAETNLRHSCKRIMDMVSSQHPWFGMEQEYTLMGTDGHPFGWPSNGFPGPQGPYYCGVGADKAYGRDIVEAHYRACLYAGIKITGTNAEVMPAQWEFQIGPCEGIRMGDHLWVARFILHRVCEDFGVIATFDPKPIPGNWNGAGCHTNFSTKAMREENGLRCIEEAIDKLSKRHQYHIRAYDPKGGLDNARRLTGFHETSNINDFSAGVANRSASIRIPRIVGQEKKGYFEDRRPSANCDPYAVTEAIVRTCLLNETGDEPFQYKN

SEQ ID NO: 890 - protein, 373 aa, Artificial sequence
  Synthetic
MATSASSHLNKGIKQMYMSLPQGEKIQAMYIWVDGTGEGLRCKTRTLDCDPKCVEELPEWNFDGSSTFQSEGSNSDMYLHPVAMFRDPFRKDPNKLVLCEVFKYNRKPAETNLRHICKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIRMGDHLWIARFILHRVCEDFGVIATFDPKPIPGNWNGAGCHTNFSTKAMREENGLKCIEEAIDKLSKRHQYHIRAYDPKGGLDNARRLTGFHETSNINDFSAGVANRSASIRIPRTVGQEKKGYFEDRRPSANCDPYAVTEAIVRTCLLNETGDEPFQYKN

SEQ ID NO: 891 - protein, 373 aa, Artificial sequence
  Synthetic
MATSASSHLNKNIKQMYLCLPQGEKVQAMYIWVDGTGEGLRCKTRTLDCEPKCVEELPEWNFDGSSTFQSEGSNSDMYLSPVAMFRDPFRREPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIHMGDHLWVARFILHRVCEDFGVIATFDPKPIPGNWNGAGCHTNFSTKAMREENGLKHIEEAIEKLSKRHQYHIRAYDPKGGLDNARRLTGFHETSNINDFSAGVANRSASIRIPRTVGQEKKGYFEDRRPSANCDPFAVTEAIVRTCLLNETGDEPFQYKN

SEQ ID NO: 892 - protein, 394 aa, Artificial sequence
  Synthetic
MATSASSHLNKNIKQMYLCLPQGEKVQAMYIWVDGTGEGLRCKTRTLDCEPKCVEELPEWNFDGSSTFQSEGSNSDMYLSPVAMFRDPFRREPNKLVFCEVFKYNRKPAETNLRHSCKRIMDMVSNQHPWFGMEQEYTLMGTDGHPFGWPSNGFPGPQGPYYCGVGADKAYGRDIVEAHYRACLYAGVKITGTNAEVMPAQWEFQIGPCEGIHMGDHLWVARFILHRVCEDFGVIATFDPKPIPGNWNGAGCHTNFSTKAMREENGLKHIEEAIEKLSKRHQYHIRAYDPKGGLDNARRLTGFHETSNINDFSAGVANRSASIRIPRTVGQEKKGYFEDRRPSANCDPFAVTEAIVRTCLLNETGDEPFQYKNWIRSDMIRYIDEFGQTTTRMQ

SEQ ID NO: 893 - DNA, 1185 bp, Artificial sequence
  Synthetic
atggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtga

SEQ ID NO: 894 - DNA, 178 bp, Artificial sequence
  Synthetic
gcacatcgcccacagtccccgagaagttggggggaggctctggctgcaggtaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 895 - DNA, 369 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 896 - DNA, 369 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 897 - DNA, 372 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 898 - DNA, 372 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 899 - DNA, 372 bp, Artificial sequence
  Synthetic
acccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 900 - DNA, 570 bp, Artificial sequence
  Synthetic
ctgggctgagacccgcagaggaagacgctctagggatttgtcccggactagcgagatggcaaggctgaggacgggaggctgattgagaggcgaaggtacaccctaatctcaatacaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaagagcatgcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 901 - DNA, 168 bp, Artificial sequence
  Synthetic
gcacatcgcccacagtccccgagaagttgggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 902 - DNA, 171 bp, Artificial sequence
  Synthetic
gcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 903 - DNA, 171 bp, Artificial sequence
  Synthetic
gcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 904 - DNA, 168 bp, Artificial sequence
  Synthetic
gcacatcgcccacagtccccgagaagttgggaggggtcggcaattgaaccggtgcctagagaaggtggcgcggggtaaactgggaaagtgatgtcgtgtactggctcagcctttttcccgagggtgggggagaaccgtatataagtgcagtagtcgccgtgaacgttc

SEQ ID NO: 905 - DNA, 171 bp, Artificial sequence
  Synthetic
gcacatcgcccacagtccccgagaagttggggggaggggtcggcaattgatccggtgcctagagaaggtggcgcggggtaaactgggaaagtgatgtcgtgtactggctccgcctttttcccgagggtgggggagaaccgtatataagtgcagtagtcgccgtgaacgttc

SEQ ID NO: 906 - DNA, 440 bp, Artificial sequence
  Synthetic
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 907 - DNA, 480 bp, Artificial sequence
  Synthetic
agcggggctgacgtcgggaggtggcctccgtgggaagggacacccggatcttgacacagccttggcagcggagtaaggaagagtagggatagattctggccgccctcttggccagcttctcgccgccccaccctccgctagggccaagagtaattcatacaaaaggagggatcgccttcgcctggggaagtcccagggaccgtcgctaaattctcataacccataatcccggtacccgccccaccacagtgcgaggagcatgcgctcagggctgagcgcggggagagcagagcacacaagctcatagaccctggtcgtggggggaggggcgcactgagcggggggggggggggtgatgggggggaggaccggggagctggcgcggggcaaactgggaaagcggtgtcgtgtgctggctccgccctcttcccgagggtgggggagaacggtatataagtgcggcagtcgccttggacgttc

SEQ ID NO: 908 - DNA, 316 bp, Artificial sequence
  Synthetic
ggagccgagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgtt

SEQ ID NO: 909 - DNA, 503 bp, Artificial sequence
  Synthetic
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcatcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 910 - DNA, 503 bp, Artificial sequence
  Synthetic
cctctcccggccagaggagcaaggtatgcgggaggcgaccaggaggatagcggggctgacgtcgggaggtggcctccgtgggaaggacacccggatcttgacacagccttggcagcggagtcaggaagagtaggggtaggttctggacgccctcttggccagctcttcgccgccccaccctctgctggagcacagagtaattcatacaaaaggagggatcgccttcgcaaggggagagcccagggaccgtccctaaattctcacagacccaaatccctgtagccgccccacgacagcgcgaggagcatgcgcccagggctgagcgcgggtagatcagagcacacaagctcacagtccccggcggtggggggaggggcgcgctgagcgggggccagggagctggcgcggggcaaactgggaaagtggtgtcgtgtgctggctccgccctcttcccgagggtgggggagaacggtatataagtgcggtagtcgccttggacgttc

SEQ ID NO: 911 - DNA, 301 bp, Artificial sequence
  Synthetic
ggagccgagagtaattcatacaaaaggagggatcgccttcgcaaggggagagcccagggaccgtccctaaattctcacagacccaaatccctgtagccgccccacgacagcgcgaggagcatgcgctcagggctgagcgcggggagagcagagcacacaagctcatagaccctggtcgtgggggggaggaccggggagctggcgcggggcaaactgggaaagcggtgtcgtgtgctggctccgccctcttcccgagggtgggggagaacggtatataagtgcggcagtcgccttggacgtt

SEQ ID NO: 912 - DNA, 459 bp, Artificial sequence
  Synthetic
ggcggggctgacgtcgggaggtggcctccacgggaagggacacccggatctcgacacagccttggcagtggagtcaggaagggtaggacagattctggacgccctcttggccagtcctcaccgccccacccccgatggagccgagagtaattcatacaaaaggagggatcgccttcgcccctgggaatcccagggaccgtcgctaaattctggccggcctcccagcccggaaccgctgtgcccgcccagcgcggcgggaggagcctgcgcctagggcggatcgcgggtcggcgggagagcacaagcccacagtccccggcggtgggggaggggcgcgctgagcgggggcccgggagccagcgcggggcaaactgggaaagtggtgtcgtgtgctggctccgccctcttcccgagggtgggggagaacggtataaaagtgcggtagtcgcgttggacgtt

SEQ ID NO: 913 - DNA, 600 bp, Artificial sequence
  Synthetic
ggggactctgaaggcaaagacggaggaggagcctgccccgggcgcgtatgggaccagcagaagaagctgttcaaggggtttgtccaggacccgcgagaggtcaaggctgaggacgggaggcgtactgcggggtgaagggataccccaacctggataccatctttgcaaagaaagcaggaacggtggagggaagattctaagcgtccccgcctggccgtctactctccgccccacccccagctgcagctgagagtaattcatacaaaaggaggactcgccttggcctcggggaatcccagggaccgtcggtaaactcccactaacctagaaccgagggctcgctcgtccccgcctcccaccccgcgctctcgtcatcatcggggtcgagaggagcatgcgcaaggcgacgggtgcttttcagtgggctgagcgcacatcgcccacggtccccgaaacgttgggggaggggacggcgattgaacgggtgcccggtggaggtggcgcggggtaaactgggaaagtcgtgtcgtgtgctgactccgccctcttcccgagggtgggggaggaccgtatataagtgccgtagtcctcttgaacgtt

SEQ ID NO: 914 - DNA, 451 bp, Artificial sequence
  Synthetic
gccaggggtgaggccaagacccgcggcagggcgaaggcacaccccagtgtccactcaacctctgtgctaagccacgaagaaaaggaagattctggactgcctttctggcgattcctagccgccccacccccggctggaaccaggagtaattcatacaaaaggaggactcgcctctgccctcgggaatcccagggaccgtcgataaattctcttaatacccgccccgcggcctccgagtcgaggagagcatgggccgccgaactggttgcggatcagggcgccgagcccacagcatcacggtccccgagggcgggggaggggacggcaagggagcaaggccaggaggaggcggcgcggggcaaactgggaaagtggtgtcgtgtgctggctccgccctctttccgagggtgggggagaacggtatataagtgccgtagtcgccctggacgtt

SEQ ID NO: 915 - DNA, 525 bp, Artificial sequence
  Synthetic
gcctggtccggggtgcgagcatcacgcctagaggctcccaacgggccaggtggcaggtgggcgacaggggaaagggacacctcactcttggcggctgagccaggaacggcagaggaacattctgggcgcccctactggccttttcctcgccgccccattcccgggtgaagctgagagtaattcatacagaagaactcgcctttgcctcggggaatcccagggaccgtggttaaactcccactaacttaaaagcgaaggatctccggggccccgcccccggctctcgtcaacctcggggtcgagaggagcatgcgcaaggagctgggtacgggtcagtgggctcagcgcacatcgcccatggtccccgagaactggttggggggaggggagaggggcggtgattgaacgagtgcctactggaggttgcgcggtgtaaactgggaaagtggtgtcgtgtgcgggctccgccctcttcccgagggtgggggagaaccgtatataagtgccgtagtcgccctggacgtt

SEQ ID NO: 916 - DNA, 220 bp, Artificial sequence
  Synthetic
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 917 - DNA, 220 bp, Artificial sequence
  Synthetic
tgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 918 - DNA, 220 bp, Artificial sequence
  Synthetic
tagtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccg

SEQ ID NO: 919 - DNA, 220 bp, Artificial sequence
  Synthetic
tggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagcgcgcgtttagtgaaccg

SEQ ID NO: 920 - DNA, 220 bp, Artificial sequence
  Synthetic
tggtgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccg

SEQ ID NO: 921 - DNA, 314 bp, Artificial sequence
  Synthetic
agtcattgggtttttccagccatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcactcattctattggctgagctgcgttctacgtgggtataagaggcgcgaccagcgtcggtaccgtcgcagtcttcggtctgaccaccgtag

SEQ ID NO: 922 - DNA, 313 bp, Artificial sequence
  Synthetic
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttgggtctgaccaccgtag

SEQ ID NO: 923 - DNA, 315 bp, Artificial sequence
  Synthetic
agtcattgggtttttccagccaatttaattaaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggtaccgtcgcagtcttcggtctgaccaccgtag

SEQ ID NO: 924 - DNA, 283 bp, Artificial sequence
  Synthetic
agtcattgggtttttccagccaatttataaaacgccatgtactttcccaccattgacgtcaatgggctattgaaactaatgcaacgtgacctttaaacggtactttcccatagctgattaatgggaaagtaccgttctcgagccaatacacgtcaatgggaagtgaaagggcagccaaaacgtaacaccgccccggttttcccctggaaattccatattggcacgcattctattggctgagctgcgttctacgtgggtataagaggcgcgaccagcgtcggta

SEQ ID NO: 925 - DNA, 293 bp, Artificial sequence
  Synthetic
aaaggccattgagtcaccacccctatgctgggaaatggtgaacgccccctatgtggaaagtccctatgggccgccattagagtgcatgaccgtgctgattcatatgccatatgagtgtattagggggctttccgcgtgggaaattgggtaaaaagtccccgtattactcacatagggggcgtttggctttgcaaattaggggatttcagtgcatttggcattaaaaactattggttctagtcataaaacgggcggagttaaccatataattgctgtcccccatgccattcgag

SEQ ID NO: 926 - DNA, 238 bp, Artificial sequence
  Synthetic
tactaatggggatttccaatgactaatacaacgggcagtacgcccagtacgtatgactaatgggactttccataatcccgccccattgacgtcaatgggcatccgttctggcaccaaaatgaatgggaatttccaatatgagtcataaaccccgccccattgacgcacattacacgtcaatgggcggtaggcgtgccctatgggcggtctatataagcagagcccgtttagtgaaccg

SEQ ID NO: 927 - DNA, 220 bp, Artificial sequence; identical to SEQ ID NO: 917
  Synthetic

SEQ ID NO: 928 - DNA, 783 bp, Artificial sequence
  Synthetic
tattaatagcaatcttagctaattaaaatagatagcgtttattgagcgttgggtatcaggcacggtcctaattcttttagatgtctttagttcgtttcactctcccccaaacaatagggtggtattgatcacctccgagcaggtgaaattgaggcacagagaaatcctagtagctggtagaagaacacgcagtgtggtcaagctagcaaggtgtttggtccactgctatatctacaaaacccctaacaatgcctggtgtatagatgctcagtatgcatttgtgggatcagtgattccgatgcctgcttcttataaagtttttatttagaaataattacaggtaaggagttgcaaaaacagtatagtgggatcgagtgtcctttttccctcggcttctcccaggggtatcgtcttacgtaacaatgtccaaacagggaaattgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 929 - DNA, 335 bp, Artificial sequence
  Synthetic
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgcaggttctcgcacgcgcacatcatcccgcaggcgagccccagcacccagcccagggtgcgcgcgcgccgtcacgtgacacgcccaaccggcgtcgccgtataaaagcgcgggcgttgacgtcagcggt

SEQ ID NO: 930 - DNA, 335 bp, Artificial sequence
  Synthetic
ggatccaacttctaagtccgttttttattgatctaaaaggccttttgcgaatcatcttgaaggcaatcgcgttctgagccacctcagctttggcacacagcgcggggactgtcgcgaggggtttagggcccaagcaggacacaccccgaaatctccgcagccacccccaccccacgcccccggctcttgagggttaaatcgcaggcgctggttctcgcacgcgcacatcatcccgcaggcgagccccagcacccagcccagggtgcgcgcgcgccgtcacgtgacacgcccaaccggcgtcgccgtataaaagcgcgggcgttgacgtcagcgtt

SEQ ID NO: 931 - DNA, 343 bp, Artificial sequence
  Synthetic
tgacttgggtataatccacagactctattcaccttgtagattggttttaatagaagtaactggacaacttgtaagctaatatcgttgctatggttctcgttctcagctaaaacggcgctctttactttgtgcacctgaacactgcacaccgagggcgaccaccgcccccgagatgcccagcttctattctagagcgccgcgccggcgccgaatgggttaacgggcggggggacacgcctccgtgcgcttgcgcggcgtcccttcgccccgccttcgcagcgcagtcacatgacccgcccaaccggcgtccgcctataaaaagctgagtgttgacgtcagcgtt

SEQ ID NO: 932 - DNA, 329 bp, Artificial sequence
  Synthetic
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcggt

SEQ ID NO: 933 - DNA, 329 bp, Artificial sequence
  Synthetic
cggtccgaatttcaaagtctttttcctattgacctacaaggttttcaagaatcatgttgtaagcaactgtgttctgaggaatctatgtttaaaaacccatccgtggatcttggcccagggtccagagactgagctagccacgccccggccgcgccgcagccactcccacggcagttcaagtgttaagtcccaaagaccgcgctctgtgcatgcgcagacccgtccacagctggctcctagccaacccggccggacgagcacccggcgccgtcacgtgacgcacccaaccggcgtcgacctataaaaggccgggcgttgacgtcagcgtt

SEQ ID NO: 934 - DNA, 325 bp, Artificial sequence
  Synthetic
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgg

SEQ ID NO: 935 - DNA, 326 bp, Artificial sequence
  Synthetic
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcgtt

SEQ ID NO: 936 - DNA, 169 bp, Artificial sequence
  Synthetic
ttcgccccgccttcgcagcgcagtcacatgacccgcccaaccggcgtccgcctataaaaagctgagtgttgacgtcagcgttctcttccgccgtcgtcgccgccatcctcggcgcgactcgcttctttcggttctacctgggagaatccaccgccatccgccaccacca

SEQ ID NO: 937 - DNA, 163 bp, Artificial sequence
  Synthetic
agcccagggtgcgcgcgcgccgtcacgtgacacgcccaaccggcgtcgccgtataaaagcgcgggcgttgacgtcagcgttctcttccgccgcagccgccgccatcgtcggcgcccctcgcacttctcctgtgcccgtgagaatccgtcgccatccgccacca

SEQ ID NO: 938 - DNA, 164 bp, Artificial sequence
  Synthetic
ggccggacgagcacccggcgccgtcacgtgacgcacccaaccggcgtcgacctataaaaggccgggcgttgacgtcagcgttctcttccgccgcagccgccgccatcgtcggcgcgcttccctgttcacctctgactctgagaatccgtcgccatccgccacca

SEQ ID NO: 939 - DNA, 280 bp, Artificial sequence
  Synthetic
tggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 940 - DNA, 282 bp, Artificial sequence
  Synthetic
tggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 941 - DNA, 280 bp, Artificial sequence
  Synthetic
tggtcgaggtgagccccacgttctgcttcactctccccatctcccccccctccccacccccaattttgtatttatttattttttaattattttgtgcagcgatgggggcggggggggggggggcgcgcgccaggtggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgg

SEQ ID NO: 942 - DNA, 283 bp, Artificial sequence
  Synthetic
tgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcggga

SEQ ID NO: 943 - DNA, 270 bp, Artificial sequence
  Synthetic
tctctctttttttttttttttttttttttttttccaaaaggaggggagagggggtaaaaaaatgctgcactgtgcggctaggccggtgagtgagcggcgcggagccaatcagcgctcgccgttccgaaagttgccttttatggctcgagtggccgctgtggcgtcctataaaacccggcggcgcaacgcgcagccactgtcgagtccgcgtccacccgcgagcacaggcctttcgcagctctttcttcgccgctccacacccgccaccag

SEQ ID NO: 944 - DNA, 294 bp, Artificial sequence
  Synthetic
tcaatctcgctttctctctcgctttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtcgcgtccacccgcgagcacagcttctttgcagctccttcgttgccggtccacacccgccaccag

SEQ ID NO: 945 - DNA, 230 bp, Artificial sequence
  Synthetic
tcaatctcgctttctctctcgcttttttttttttcttcttctttttttttttttttttcaaaaggaggggagagggggtaaaaaaatgctgcactgtgcggcgaggccggtgagtgagcgacgcggagccaatcagcgcccgccgttccgaaagttgccttttatggctcgagtggccgctgtggcgtcctataaaacccggcggcgcaacgcgcagccactgtcgagtc

SEQ ID NO: 946 - DNA, 308 bp, Artificial sequence
  Synthetic
acctcttcctcaactcacttctctctactctcacttttttttttcttcttcttttttttttttttttttttttttttttttgcaaaagaagggggtaaaaaaatgctgcactgtcgggcgaggccggtgagtgagcgagccggagccaatcagcgcccgccgttccgaaattgccttttatggctcgagtggccgctgtggcgtcctataaaacccggcggcgcaacgcgcgccactgtcgagtccgcgtccacccgcgagtacaacctccttgcagctcctccgtcccggtccacacccgccaccag

SEQ ID NO: 947 - DNA, 253 bp, Artificial sequence
  Synthetic
gcccagcaccccaaggcggccaacgccaaaactctccctcctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccgcggcggcgccctataaaacccagcggcgcgacgcgccaccaccgccgagtc

SEQ ID NO: 948 - DNA, 61 bp, Artificial sequence
  Synthetic
ttgccttttatggctcgagtggccgctgtggcgtcctataaaacccggcggcgcaacgcgc

SEQ ID NO: 949 - DNA, 494 bp, Artificial sequence
  Synthetic
atgacgtcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttc

SEQ ID NO: 950 - DNA, 486 bp, Artificial sequence
  Synthetic
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacatctcttcccttctctctccttccaccgcccgttaccgtccctaggaaattttactctgctggagagcttcttctacggcccccttgcagcaatgcacttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 951 - DNA, 486 bp, Artificial sequence
  Synthetic
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctcttcccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 952 - DNA, 486 bp, Artificial sequence
  Synthetic
tttttgtagaaatgtcttggtgtcctcgtccaatcaggtagccatctctgaaatatctggctccgttgcaactccgaacgacctgctggcaacgtaaaattctccggggtaaaacttaaatgtggagtaatggaaccagaaacgtctcttcccttctctctccttccaccgcccgttaccgtccctaggaaattttactctgctggagagcttcttctacggcccccttgcagcaatgctctacccagcattacgttgcgggtaaaacggaggtcgtgtacccgacctagcagcccagggatggaaaagtcccggccgtcgctggcaataatagcgggcggacgcatgtcatgagattattggaaaccaccagaatcgaatataaaaggcgaacacctttcccaattttggtttctcctgacccaaagactttaaatttaatttatttgtccctatttcaatcaattgaacaactatcaaaacaca

SEQ ID NO: 953 - DNA, 843 bp, Artificial sequence
  Synthetic
taccaaaaaacctggagaagttcctcagcttgcccgcctcccagcctttgaaagaataggggaagggggtggcgcgtgctgtccccaggcgaccgggctcaggctccgactccccatgccagccgctcccgggtcgtccgtgcggccccttggcgcggcctgggctcctggacctctctggttcccaccaggatccccatccccgagtctatagtggcttgcgtgcccatagtcccgtcccgggaacctttagccatcactgcccccgcgggccacctcggtcccctccccctctcaggcctgggcccacatgcctggtgcgtgcactggggaacaaggcgggcccgcaaaaagaaaaacgaggaggcccggctactcgcgggtttacgggcgcacgtagctcaggcctcctcgcccttgggctgggactgggcgagcagcacgggaggcggggcgcacgtcacccacgccccgccgcccccagtccctataaattgaggctgcgggttcctccggtgctctctgctccgccccgttcgacaggcagccgcttcttctcgtgcagtgctaggtgaccaaggcagaggccgtgggggcttgggggccggcgggaggagggggcgtgctggccggggcttgggcagccccgaggcggtgctgggcccccagagcggagccgccgggcggggtcccgcattgcaggggcgagcagagtacgtgccgtgccctggggtgggaatggaggccggggggaggggcgccgagggctctggccgctgggctttgccgactgccctgatgctcactctcctctccccacagcgcgtccccgagactgccacc

SEQ ID NO: 954 - DNA, 799 bp, Artificial sequence
  Synthetic
atcctcaacttttccacagcctttgcataaaggggagagggtcggcggtgcagctgtggcacacacgcacttctgctcaacccgcccccccccgcccccgttcctgttccttcccaggttctccccattttatcggggcggcaacttttaggtccctgggtcctggaagtccttagtacacactcttcgtccttaagtccatagtctgtattccctcggtcctatcctgtcccccatcaccgggtcacctccccagcgaagcaatctcagttcccctccccctctcagccccgagcccacacgtttggtgcgtgcacatttcaaaaacgaggcgggtccaaagagagggggtggggaggtgccgagtggcccagctactcgcggctttacgggtgcacgtagctcaggcctcagcgcccttgagctgtgactggatggatgagcggggcgggaggcggggcgagcgtcctcggcgctccccaccaccccagttcctataaatacggactgcagccctccccggtgctctctgctcctccctgttctagagacagccgcatctttccgtgcagtgccaggtgaaaaccgcagagtgggccgcaggtggccggggacggtcggaaacggggaaggggggcgctcagcccgggactgcgggcgctggggcgagctccactgcccgagcccgggctccgcattgcagaggctggagggggaagggatggggggcgcggcggggggcacgctgacctctctttcttctctctccctccgcagcctcgctccggagactgccacc

SEQ ID NO: 955 - DNA, 163 bp, Artificial sequence
  Synthetic
ggagacgccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 956 - DNA, 185 bp, Artificial sequence
  Synthetic
ggagacggcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 957 - DNA, 224 bp, Artificial sequence
  Synthetic
ggagacggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 958 - DNA, 275 bp, Artificial sequence
  Synthetic
ggagacgacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccag

SEQ ID NO: 959 - DNA, 122 bp, Artificial sequence
  Synthetic
ggagacgcgagtcaccgcctgccgccgcgcccccggtttctataaattgagcccgcagcctcccgcttcgctctctgctcctcctgttcgacagtcagccgcatcttcttttgcgtcgccag

SEQ ID NO: 960 - DNA, 167 bp, Artificial sequence
  Synthetic
ggagacgcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 961 - DNA, 190 bp, Artificial sequence
  Synthetic
ggagacggcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 962 - DNA, 211 bp, Artificial sequence
  Synthetic
ggagacgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 963 - DNA, 239 bp, Artificial sequence
  Synthetic
ggagacggcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 964 - DNA, 278 bp, Artificial sequence
  Synthetic
ggagacggggaatgagagaggcccagctactcgcggctttacgggtgcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 965 - DNA, 413 bp, Artificial sequence
  Synthetic
ggagacgtcctatcctgggaaccctcatccggtcacttcctcggcgggacaatctcagctcccctccccctctcaggtcggagcccacacgcttggtgcgtgcacatttcaaaaacgaggcgggtccaaaaagagggagggggggaatgagagaggcccagctactcgcggctttacgggtgcacgtagctcaggcctctgcgcccttgagctgggactggatgagccgagcgggaggcggggcgcgcgtcatcagctccccccaccatccagttcctataaatacggactgcagccctccctggtgctctctgctcctccctgttctagagacagccgcatcttcttgtgcagtgccaggctctctgctcctcctgttcgacagtcagccgcatcttcttttgcgtcgccag

SEQ ID NO: 966 - DNA, 508 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 967 - DNA, 460 bp, Artificial sequence
  Synthetic
ctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtc

SEQ ID NO: 968 - DNA, 466 bp, Artificial sequence
  Synthetic
cggggttggggttgcgccttttccaaggcagccctgggtttgcgcagggacgcggctgctctgggcgtggttccgggaaacgcagcggcgccgaccctgggcctcgcacattcttcacgtccgttcgcagcgtcacccggatcttcgccgctacccttgtgggccccccggcgacgcttcctcgtccgcccctaagtcgggaaggttccttgcggttcgcggcgtgccggacgtgacaaacggaagccgcacgtctcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtc

SEQ ID NO: 969 - DNA, 458 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgagagcagcggccgggaaggggcggtgcgggaggcggggtgtggggcggtagtgtgggccctgttcctgcccgcgcggtgttccgcattctgcaagcctccggagcgcacgtc

SEQ ID NO: 970 - DNA, 523 bp, Artificial sequence
  Synthetic
cacgggtgggggtgagcgcttttcctaaggcagcctaggactaaagcagcgccacagatactttgggtgtggctcctgaaccgcggctgcagaagctacgggcctctcaaactttccacgtccaagtcgtagcacgacgcagctcccttccgccccacctgcaggtcgctcgatgccgcctctcgctccgcccctagtcaggaaggttcccccgcagctcgcagcgtgccggacgtgacaaatggaagccgcacgtcccaccagtaccctcgcagacggacagcgccttggagcaatggcagcgagccggcccctttgggccagggccaatagcggccgctctgcttggcgcgccctgagccgcggccgggaaggggcggtgcgggaggcggggcgtcggggggcggtgcgggcgcgctcccggtgggcgaggtgctcagcattctgcacgcgtctggacagcgcgtcggtcgcattatccttctctcagtctccaacctctcgccctcgccttattgccacc

SEQ ID NO: 971 - DNA, 527 bp, Artificial sequence
  Synthetic
cacggggttggggttgcgccttttccaaggcagccctgggtttgcgcagggatgcggctgctctgggcgtggttccgggaaacgcagcggcgccgaccttgggtcttgcacattcttcacgtccgttcgcagcgtcacccggatcttcgccgctacccttgtgggccccccggcgacgcttcctgctccgcccctaagtcgggaaggttccttgcggttcgcggcgtgccggacgtgacaaacggaagccgcacctctcactagtaccctcgcagacggacagcgccaaggagcaatggcagcgcgccgaccgcgatgggctgtggccaatagcggctgctcagcagggcgcgccgggagcagcggccgggaaggggcggtgcgggaggcggggtgtggggcggtagtgtggcccctgttcctgcccgcgcggtgttcggcattctgcaagcctccggagcggacgtcagcagtcggctccctcgttgaccgaatcaccgacctctctccccagctgtattgccacc

SEQ ID NO: 972 - DNA, 660 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcaagcttggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 973 - DNA, 655 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcac

SEQ ID NO: 974 - DNA, 653 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggatttttt

SEQ ID NO: 975 - DNA, 1092 bp, Artificial sequence
  Synthetic
aagtttccagagctttcgaggaaggtttcttcaactcaaattcatccgcctgataattttcttatattttcctaaagaaggaagagaagcgcatagaggagaagggaaataattttttaggagcctttcttacggctatgaggaatttggggctcagttgaaaagcctaaactgcctctcgggaggttgggcgcggcgaactactttcagcggcgcacgcagacggcgtctacgtgaggggtgataagtgacgcaacactcgttgcataaatttgcgctccgccagcccggagcatttaggggcggttggctttgttgggtgagcttgtttgtgtccctgtgggtggacgtggttggtgattggcaggatcctggtatccgctacaggtactggcccacagccgtaaagagctgcgggggcgtgagaggggggaatgggtgaggtcaagctggaggcttcttggggttgggtgggccgctgaggggaggggagggcgaggtgacgcgacacccggcctttctgggagagtgggccttgttgacctaaggggggcgagggcagttggcacgcgcacgcgccgacagaaactaacagacattaaccaacagcgattccgtcgcgtttacttgggaggaaggcggaaaagaggtagtttgtgtggcttctggaaaccctaaatttggaatcccagtatgagaatggtgtcccttcttgtgtttcaatgggatttttacttcgcgagtcttgtgggtttggttttgttttcagtttgcctaacaccgtgcttaggtttgaggcagattggagttcggtcgggggagtttgaatatccggaacagttagtggggaaagctgtggacgcttggtaagagagcgctctggattttccgctgttgacgttgaaaccttgaatgacgaatttcgtattaagtgacttagccttgtaaaattgaggggaggcttgcggaatattaacgtatttaaggcattttgaaggaatagttgctaattttgaagaatattaggtgtaaaagcaagaaatacaatgatcctgaggtgacacgcttatgttttacttttaaactaggtca

SEQ ID NO: 976 - DNA, 215 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcag

SEQ ID NO: 977 - DNA, 753 bp, Artificial sequence
  Synthetic
aaatgagtcttcggacctcgcgggggccgcttaagcggtggttagggtttgtctgacgcggggggagggggaaggaacgaaacactctcattcggaggcggctcggggtttggtcttggtggccacgggcacgcagaagagcgccgcgatcctcttaagcacccccccgccctccgtggaggcgggggtttggtcggcgggtggtaactggcgggccgctgactcgggcgggtcgcgcgccccagagtgtgaccttttcggtctgctcgcagacccccgggcggcgccgccgcggcggcgacgggctcgctgggtcctaggctccatggggaccgtatacgtggacaggctctggagcatccgcacgactgcggtgatattaccggagaccttctgcgggacgagccgggtcacgcggctgacgcggagcgtccgttgggcgacaaacaccaggacggggcacaggtacactatcttgtcacccggaggcgcgagggactgcaggagcttcagggagtggcgcagctgcttcatccccgtggcccgttgctcgcgtttgctggcggtgtccccggaagaaatatatttgcatgtctttagttctatgatgacacaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagcgacccgcttaa

SEQ ID NO: 978 - DNA, 270 bp, Artificial sequence
  Synthetic
cagtgtggttttcaagaggaagcaaaaagcctctccacccaggcctggaatgtttccacccaatgtcgagcagtgtggttttgcaagaggaagcaaaaagcctctccacccaggcctggaatgtttccacccaatgtcgagcaaaccccgcccagcgtcttgtcattggcgaattcgaacacgcagatgcagtcggggcggcgcggtcccaggtccacttcgcatattaaggtgacgcgtgtggcctcgaacaccgagcgaccctgcagg

SEQ ID NO: 979 - DNA, 149 bp, Artificial sequence
  Synthetic
tcccgcccctaactccgcccagttccgcccattctccgccccatggctgactaattttttttatttatgcagaggccgaggccgcctcggcctctgagctattccagaagtagtgaggaggcttttttggaggtataggcttttgcaaa

SEQ ID NO: 980 - DNA, 128 bp, Artificial sequence
  Synthetic
gttccgcccattctccgccccatggctgactaattttttttatttatgcagaggccgaggccgcctcggcctctgagctattccagaagtagtgaggaggcttttttggaggcctaggcttttgcaaa

SEQ ID NO: 981 - DNA, 408 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 982 - DNA, 100 bp, Artificial sequence
  Synthetic
ttggcgaaaacacgcagatgcagtcggggcggcgcggtcccaggtccacttcgcatattaaggtgacgcgtgtggcctcgaacacagagcgactctgcag

SEQ ID NO: 983 - DNA, 193 bp, Artificial sequence
  Synthetic
ggacacaagacaggcttgcgagatatgtttgagaataccactttatcccgcgtcagggagaggcagtgcgtaaaaagacgcggactcatgtgaaatactggtttttagtgcgccagatctctataatctcgcgcaacctattttcccctcgaacactttttaagccgtagataaacaggctgggacacttcac

SEQ ID NO: 984 - DNA, 318 bp, Artificial sequence
  Synthetic
ctcactctcttccgcatcgctgtctgcgagggccagctgttgggctcgcggttgaggacaaactcttcgcggtctttccagtactcttggatcggaaacccgtcggcctccgaacggtactccgccaccgagggacctgagcgagtccgcatcgaccggatcggaaaacctctcgagaaaggcgtctaaccagtcacagtcgcaaggtaggctgagcaccgtggcgggcggcagcgggtggcggtcggggttgtttctggcggaggtgctgctgatgatgtaattaaagtaggcggtcttgagagggcggatggtcga

SEQ ID NO: 985 - DNA, 194 bp, Artificial sequence
  Synthetic
ggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcac

SEQ ID NO: 986 - DNA, 192 bp, Artificial sequence
  Synthetic
ggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggatttttt

SEQ ID NO: 987 - DNA, 300 bp, Artificial sequence
  Synthetic
acgtgacggagcgtgaccgcgcgccgagcgcgcgccaaggtcgggcaggaagagggcctatttcccatgattccttcatatttgcatatacgatacaaggctgttagagagataattagaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacacc

SEQ ID NO: 988 - DNA, 300 bp, Artificial sequence
  Synthetic
ggaggcctcaccccctacctcggccgctccagggggcgggcctgcatctgggccacctcttttgcatattggcacccacaatccaccgcggctatgaggccagtataaggcggtaaaattacgataagatatgggattttacgtgatcgaagacatcaaagtaagcgtaagcacgaaagttgttctgcaacataccactgtaggaaattatgctaaatatgaaaccgaccataagttatcctaaccaaaagatgatttgattgaagggcttaaaataggtgtgacagtaacccttgagtc

SEQ ID NO: 989 - DNA, 300 bp, Artificial sequence
  Synthetic
aagtccgcggcacgagaaatcaaagccccggggcctgggtcccacgcggggtcccttacccagggtgccccgggcgctcatttgcatgtcccacccaacaggtaaacctgacagatcggtcgcggccaggtacggcctggcggtcagagcaccaaacttacgagccttgtgatgagttccgttacatgaaattctcctaaaggctccaagatggacaggaaagcgctcgattcggttaccgtaaggaaaacaaatgagaaactcccgtgccttataagacctggggacggacttatttgc

SEQ ID NO: 990 - DNA, 300 bp, Artificial sequence
  Synthetic
gctccgcggcacgagaactcaaagccccggggcctgggtcccacgcggggtcccttacccagggtgccccgggcgctcatttgcatgtcccacccaacaggtaaacctgacaggtcatcgcggccaggtacgacctggcggtcagagcaccaaacatacgagccttgtgatgagttccgttgcatgaaattctcccaaaggctccaagatggacaggaaagggcgcggttcggtcaccgtaagtagaataggtgaaagactcccgtgccttataaggcctgtgggtgacttcttctcaac

SEQ ID NO: 991 - DNA, 300 bp, Artificial sequence
  Synthetic
gcctgaggcgtggggccgcctcccaaagacttctgggagggcggtgcggctcaggctctgccccgcctccggggctatttgcatacgaccatttccagtaattcccagcagccaccgtagctatatttggtagaacaacgagcactttctcaactccagtcaataactacgttagttgcattacacattggaatagaggttaaatctctaggtcatttaagagaagtcggcctatgtgtacgctaatataagacatttgttccaggggctttaaatagctggtggtggaactcaatattc

SEQ ID NO: 992 - DNA, 217 bp, Artificial sequence
  Synthetic
cgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgaggaccac

SEQ ID NO: 993 - DNA, 1296 bp, Artificial sequence
  Synthetic
cagcaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggagacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagacctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtcttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcacgtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtctcgctctggtcttctacgtggaaatgaacgagagccacacgcctgcgtgtgcgagaccgtcccggcaacggcgacgcccacaggcattgcctccttcacggagagagggcctggcacactcaagactcccacggaggttcagttccacactcc

SEQ ID NO: 994 - DNA, 1296 bp, Artificial sequence
  Synthetic
caccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactcc

SEQ ID NO: 995 - DNA, 433 bp, Artificial sequence
  Synthetic
ggcgggagggaaggcgggcagagatggagagaggaacgggagacctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtcttcacccgcgcggttcacagaccgcacatccccaggctgagc

SEQ ID NO: 996 - DNA, 433 bp, Artificial sequence
  Synthetic
ggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagc

SEQ ID NO: 997 - DNA, 65 bp, Artificial sequence
  Synthetic
agaggggcggaagggacgttaggagggaggcagggaggcagggaggcagggaggaacggagggag

SEQ ID NO: 998 - DNA, 1213 bp, Artificial sequence
  Synthetic
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatatt

SEQ ID NO: 999 - DNA, 246 bp, Artificial sequence
  Synthetic
gcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctt

SEQ ID NO: 1000 - DNA, 64 bp, Artificial sequence
  Synthetic
atcacgcatgggatacgtcgtggcagtaaaagggcttaaatgccaacgacgcgtcccatacgtt

SEQ ID NO: 1001 - DNA, 82 bp, Artificial sequence
  Synthetic
atgacgcatgggatacgtcgtggcagtaaaagggcttaaatgccaacgacgcgtcccatacgttgttggcattttaagtctt

SEQ ID NO: 1002 - DNA, 106 bp, Artificial sequence
  Synthetic
cctgggtaaactaaaagtcccctcgaggaaaggcccctaaagtgaaacagtgcaaaacgttcaaaaactgtctggcaatacaagttccactttgggacaaatcggc

SEQ ID NO: 1003 - DNA, 105 bp, Artificial sequence
  Synthetic
cctgggtaaactaaaagtcccctcgaggaaaggcccctaaagtgaaacagtgcaaaacgttcaaaaactgtctggcaatacaagttccactttgaccaaaacggc

SEQ ID NO: 1004 - DNA, 14 bp, Artificial sequence
  Synthetic
ccytttbmctgcca

SEQ ID NO: 1005 - DNA, 14 bp, Artificial sequence
  Synthetic
tggcagkvaaargg

SEQ ID NO: 1006 - DNA, 14 bp, Artificial sequence
  Synthetic
ccctttgcctgcca

SEQ ID NO: 1007 - DNA, 14 bp, Artificial sequence
  Synthetic
tggcagtgaaaggg

SEQ ID NO: 1008 - DNA, 205 bp, Artificial sequence
  Synthetic
cagggtatctcataccctggtaaaattttaaagttgtgtattttataaaattttcgtctgacaacactagcgcgctcagtagctggaggcaggagcgtgcgggaggggatagtggcgtgatcgcagtgtggcacgggacaccggcgagatattcgtgtgcaaacctgtttcgggtatgttataccctgcctcattgttgacgtat

SEQ ID NO: 1009 - DNA, 192 bp, Artificial sequence
  Synthetic
tttaagaaaaagattaataaataataataatttcataattaaaaacttctttcattgaatgccattaaataaaccattattttacaaaataagatcaacataattgagtaaataataataagaacaatattatagtacaacaaaatatgggtatgtcataccctgccacattcttgatgtaactttttttca

SEQ ID NO: 1010 - DNA, 16 bp, Artificial sequence
  Synthetic
cccggcgagcatgagg

SEQ ID NO: 1011 - DNA, 16 bp, Artificial sequence
  Synthetic
cctcatgctcgccggg

SEQ ID NO: 1012 - DNA, 296 bp, Artificial sequence
  Synthetic
gtctgcgtaaaattgacgcatgcattcttgaaatattgctctctctttctaaatagcgcgaatccgtcgctgtgcatttaggacatctcagtcgccgcttggagctcccgtgaggcgtgcttgtcaatgcggtaagtgtcactgattttgaactataacgaccgcgtgagtcaaaatgacgcatgattatcttttacgtgacttttaagatttaactcatacgataattatattgttatttcatgttctacttacgtgataacttattatatatatattttcttgttatagatatc

SEQ ID NO: 1013 - DNA, 218 bp, Artificial sequence
  Synthetic
tttgttactttatagaagaaattttgagtttttgtttttttttaataaataaataaacataaataaattgtttgttgaatttattattagtatgtaagtgtaaatataataaaacttaatatctattcaaattaataaataaacctcgatatacagaccgataaaacacatgcgtcaattttacgcatgattatctttaacgtacgtcacaatatgat

SEQ ID NO: 1014 - DNA, 13 bp, Artificial sequence
  Synthetic
ccctagaaagata

SEQ ID NO: 1015 - DNA, 13 bp, Artificial sequence
  Synthetic
tatctttctaggg

SEQ ID NO: 1016 - DNA, 15 bp, Artificial sequence
  Synthetic
cacttggattgcggg

SEQ ID NO: 1017 - DNA, 15 bp, Artificial sequence
  Synthetic
cccgacaccgtagtg

SEQ ID NO: 1018 - DNA, 262 bp, Artificial sequence
  Synthetic
aaacgagttaagtcggctcgcgtgaattgcgcgtactccgcgggagccgtcttaactcggttcatatagatttgcggtggagtgcgggaaacgtgtaaactcgggccgattgtaactgcgtattaccaaatatttgtttccaagcttggtaccgagctcggatcccgtacgctgcaggtcgacggatccccgggttaattaaggcgcgccagatctgtttagcttgcctcgtccccgccgggtcacccggccagcgacatgg

SEQ ID NO: 1019 - DNA, 227 bp, Artificial sequence
  Synthetic
tgtcgaagaattcggcggccgcatgcatctagagaattatttatgtactgaatagataaaaaaatgtctgtgattgaataaattttcattttttacacaagaaaccgaaaatttcatttcaatcgaacccatacttcaaaagatataggcattttaaactaactctgattttgcgcgggaaacctaaataattgcccgcgccatcttatattttggcgggaaattca

SEQ ID NO: 1020 - DNA, 297 bp, Artificial sequence
  Synthetic
gggtttattagacccaccactttgaaaaacctatgatatttttttaaattgaaggctattgttgacgtgtgttatagtagcttcgcgcaataaaccggcggccattttgacgagcgaacttcagtctcacgtgagcgtgcgtgcgagtagcacgtgtgtaaagtgcgcgcgggcccgtgggaccctaccaggcatacaacgtaacattctgtcggtaagaatattttctttattttttggcatttctttgtttaatgtgttaaattataatacgaaaaaaatattgttgcagtagaa

SEQ ID NO: 1021 - DNA, 337 bp, Artificial sequence
  Synthetic
atcttttcgattatccaaagataatagtattttagttgatttattagtgccttaaattaatgaaagtctgacttcgatctctgcattatatgtaagattgttaattatagaactaagagtttaatttctgttaattaaaattaagcgattttgaataattgttaaataaagatattttcacatacatttacatattttatttattatctgtaataataatacattctaaaagacataaatataaaacaaaattttcctagcttgttcatttgtgtaaaacatgtattttcaatatcgggtttgacagacccaccaggcatgccgtgtgatttttatg

SEQ ID NO: 1022 - DNA, 18 bp, Artificial sequence
  Synthetic
cccttgrcatgcctggta

SEQ ID NO: 1023 - DNA, 18 bp, Artificial sequence
  Synthetic
taccaggcatgycaaggg

SEQ ID NO: 1024 - DNA, 273 bp, Artificial sequence
  Synthetic
gggcttttcgagcctagcgaaagtgaaattgttcccctcctcccttcccccgcgcgcgacaaacccgtaacttctagtagcttcgatgttagttgcgcctaggccgtcagaagcttcgcacgtgttttcgtgcgcaattcggtaagtaaattcaatttgaaatttgtcgcgggcttcttaggccccacctcagtgtttacgtaacttttttgtaaatagtttcgattaagttattgtgttttttttttgcagtagcttgaaaacgtttgaaaa

SEQ ID NO: 1025 - DNA, 370 bp, Artificial sequence
  Synthetic
ttttggtgcttgtattttttttcttcccataatacaaagataattatgaatgtgcctaatgctaaaaagactgttaaaaattaatattttatgtaagtttgttgattatttctaatattttaatgaatactttgtgatttttgatctcatgtgattttgccaaaaattttgctaagtgttttttaaaaacactcaaaagttaattataaataaaaaaattaaacaaaaaacattttattttatttaaaatctatccacaaaagcttattattatacaataaaacctaaaaaccccaaatattttaaaatatgaacatttatatacacgggccgcggaggcccccacgtcagtacttacgtgaaaataatt

SEQ ID NO: 1026 - DNA, 19 bp, Artificial sequence
  Synthetic
cctttarctrctgaggtgg

SEQ ID NO: 1027 - DNA, 19 bp, Artificial sequence
  Synthetic
ccacctcagyagytaaagg

SEQ ID NO: 1028 - DNA, 401 bp, Artificial sequence
  Synthetic
aagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagacccaggtgtgtgtgggggaggagctttctctcccttgtccttgtcactgttctcgtgtcatctctttgagaaacagcaaaa

SEQ ID NO: 1029 - DNA, 247 bp, Artificial sequence
  Synthetic
agatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttc

SEQ ID NO: 1030 - DNA, 15 bp, Artificial sequence
  Synthetic
ccctcrtattatgtt

SEQ ID NO: 1031 - DNA, 15 bp, Artificial sequence
  Synthetic
aacataataygaggg

SEQ ID NO: 1032 - DNA, 15 bp, Artificial sequence
  Synthetic
ccctcatattatgtt

SEQ ID NO: 1033 - DNA, 15 bp, Artificial sequence
  Synthetic
aacataatacgaggg

SEQ ID NO: 1034 - DNA, 303 bp, Artificial sequence
  Synthetic
tacgtaaatttgacgtataccgcggcgaaatatatctgtctctttcacgtttaccgtcggattcccgctaacttcggaaccaactcagtagccattgagaactcccaggacacagttgcgtcatctcggtaagtgccgccattttgttgtaatagacaggttgcacgtcattttgacgtataattgggctttgtgtaacttttgaaattatttataatttttattgatgtgatttatttgagttaatcgtattgtttcgttacatttttcatatgatattaatattttcagattgaatataaa

SEQ ID NO: 1035 - DNA, 347 bp, Artificial sequence
  Synthetic
agactgttttttttaaaaggcttataaagtattactattgcgtgatttaattttataaaaatatttaaaaccagttgatttttttaataattacctaattttaagaaaaaatgttagaagcttgatatttttgttgatttttttctaagatttgattaaaaggccataattgtattaataaagagtatttttaacttcaaatttattttatttattaattaaaacttcaattatgataatacatgcaaaaatatagttcatcaacagaaaaatataggaaaactctaatagttttatttttacacgtcatttttacgtatgattgggctttatagctagtcaaatat

SEQ ID NO: 1036 - DNA, 16 bp, Artificial sequence
  Synthetic
ccctagaagcccaatc

SEQ ID NO: 1037 - DNA, 16 bp, Artificial sequence
  Synthetic
gattgggcttctaggg

SEQ ID NO: 1038 - DNA, 304 bp, Artificial sequence
  Synthetic
tacgtaaatttgacgtataccgcggcgaaatatctctgttactttcacgtttaacgtcggatcgccgctaacttctgaaccaactcagtagccattgggacctcgcaggacacagttgcatcatctcggtaagtgccgccattttgttgtaatagagaggttgcacgtcattttgacgtataattgggctttgtgtaacttttgaaattgtttaaatttttttaaatttgtgatttatttgagttaatcgtattgtttcgttacattttacatgtaatattaatattttcaggttgaatacaaa

SEQ ID NO: 1039 - DNA, 370 bp, Artificial sequence
  Synthetic
tgtttgtcaagactgtatataaagactgtttttttctaagaaacttataaaatattattacaagttgatttaattttatgaaaaaatttaaaactagttgattttttttataattacataattttaagaaaaagtgttagaggcttgatttttttgtttttttttttctaaggtttgattgaaatgccataatagtattaataaagagtattttttaacttaaaatctattttatttattaattaaaacttcaattatgataactcatgcaaaaatatagttcattaacagaaaaatcttggaaaactctgaagttttatttttacacgtcatttttacgtatgattgggctttataactagttaaatat

SEQ ID NO: 1040 - DNA, 16 bp, Artificial sequence
  Synthetic
ccctagaagcccaatc

SEQ ID NO: 1041 - DNA, 16 bp, Artificial sequence
  Synthetic
gattgggcttctaggg

SEQ ID NO: 1042 - DNA, 227 bp, Artificial sequence
  Synthetic
cagttgaagtcggaagtttacatacacttaagttggagtcattaaaactcgtttttcaactacaccacaaatttcttgttaacaaacaatagttttggcaagtcagttaggacatctactttgtgcatgacacaagtcatttttccaacaattgtttacagacagattatttcacttataattcactgtatcacaattccagtgggtcagaagtttacatacactaa

SEQ ID NO: 1043 - DNA, 229 bp, Artificial sequence
  Synthetic
ttgagtgtatgttaacttctgacccactgggaatgtgatgaaagaaataaaagctgaaatgaatcattctctctactattattctgatatttcacattcttaaaataaagtggtgatcctaactgaccttaagacagggaatctttactcggattaaatgtcaggaattgtgaaaaagtgagtttaaatgtatttggctaaggtgtatgtaaacttccgacttcaactg

SEQ ID NO: 1044 - DNA, 32 bp, Artificial sequence
  Synthetic
cagttgaagtcggaagtttacatacacttaag

SEQ ID NO: 1045 - DNA, 32 bp, Artificial sequence
  Synthetic
ctaaggtgtatgtaaacttccgacttcaactg

SEQ ID NO: 1046 - protein, 567 aa, Artificial sequence
  Synthetic
MSQHSDYSDDEFCADKLSNYSCDSDLENASTSDEDSSDDEVMVRPRTLRRRRISSSSSDSESDIEGGREEWSHVDNPPVLEDFLGHQGLNTDAVINNIEDAVKLFIGDDFFEFLVEESNRYYNQNRNNFKLSKKSLKWKDITPQEMKKFLGLIVLMGQVRKDRRDDYWTTEPWTETPYFGKTMTRDRFRQIWKAWHFNNNADIVNESDRLCKVRPVLDYFVPKFINIYKPHQQLSLDEGIVPWRGRLFFRVYNAGKIVKYGILVRLLCESDTGYICNMEIYCGEGKRLLETIQTWSPYTDSWYHIYMDNYYNSVANCEALMKNKFRICGTIRKNRGIPKDFQTISLKKGETKFIRKNDILLQVWQSKKPVYLISSHSAEMEESQNIDRTSKKKIVKPNALIDYNKHMKGVDRADQYLSYYSILRRWKWTKRLAMYMINCALFNSYAVYKSVRQRKMGFKMFLKQTAHWLTDDIPEDMDIVPDLQPVPSTSGMRAKPPTSDPPCRLSMDMRKHTLQAIVGSGKKKNILRRCRVCSVHKLRSETRYMCKFCNIPLHKGACFEKYHTLKN

SEQ ID NO: 1047 - protein, 594 aa, Artificial sequence
  Synthetic
MGSSLDDEHILSALLQSDDELVGEDSDSEVSDHVSEDDVQSDTEEAFIDEVHEVQPTSSGSEILDEQNVIEQPGSSLASNRILTLPQRTIRGKNKHCWSTSKSTRRSRVSALNIVRSQRGPTRMCRNIYDPLLCFKLFFTDEIISEIVKWTNAEISLKRRESMTSATFRDTNEDEIYAFFGILVMTAVRKDNHMSTDDLFDRSLSMVYVSVMSRDRFDFLIRCLRMDDKSIRPTLRENDVFTPVRKIWDLFIHQCIQNYTPGAHLTIDEQLLGFRGRCPFRVYIPNKPSKYGIKILMMCDSGTKYMINGMPYLGRGTQTNGVPLGEYYVKELSKPVHGSCRNITCDNWFTSIPLAKNLLQEPYKLTIVGTVRSNKREIPEVLKNSRSRPVGTSMFCFDGPLTLVSYKPKPAKMVYLLSSCDEDASINESTGKPQMVMYYNQTKGGVDTLDQMCSVMTCSRKTNRWPMALLYGMINIACINSFIIYSHNVSSKGEKVQSRKKFMRNLYMSLTSSFMRKRLEAPTLKRYLRDNISNILPKEVPGTSDDSTEEPVMKKRTYCTYCPSKIRRKANASCKKCKKVICREHNIDMCQSCF

SEQ ID NO: 1048 - protein, 340 aa, Artificial sequence
  Synthetic
MGKSKEISQDLRKRIVDLHKSGSSLGAISKRLAVPRSSVQTIVRKYKHHGTTQPSYRSGRRRVLSPRDERTLVRKVQINPRTTAKDLVKMLEETGTKVSISTVKRVLYRHNLKGHSARKKPLLQNRHKKARLRFATAHGDKDRTFWRNVLWSDETKIELFGHNDHRYVWRKKGEACKPKNTIPTVKHGGGSIMLWGCFAAGGTGALHKIDGIMDKENYVDILKQHLKTSVRKLKLGRKWVFQHDNDPKHTSKVVAKWLKDNKVKVLEWPSQSPDLNPIENLWAELKKRVRARRPTNLTQLHQLCQEEWAKIHPNYCGKLVEGYPKRLTQVKQFKGNATKY

SEQ ID NO: 1049 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 1050 - protein, 589 aa, Artificial sequence
  Synthetic
MAKRFYSAEEAAAHCMAPSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWNTTTVLSIPVFSATMSRNRYQLLLRFLHFNNNATAVPPDQPDHDRLHKLRPLIDSLSERFAAVYTPCQNICIDESLLLFKGRLRFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRTRKGLPRALLDKKLNRGETYALRKNELLAIKFFDKKNVFMLTSIHDESVIREQRVGRPPKNKPLCSKEYSKYMGGVDRTDQLQHYYNATRKTSAWYKKVGIYLIQMALRNSYIVYKAAVPGPKLSYYKYQLQILPALLFGGVEEQTVPEMLPSDNVARLIGKHFIDTLPPTPGKQRPQKGCKVCRKRGIRRDTRYYCPKCPRNPGLCFKPCFEIYHTQLHY

SEQ ID NO: 1051 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNYEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 1052 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLNIPVFSATMSRNRYQLLLRFLEFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 1053 - protein, 589 aa, Artificial sequence
  Synthetic
MAKRFYSAEEAAAHCMASSQEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFKQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 1054 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGVYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 1055 - protein, 589 aa, Artificial sequence
  Synthetic
MAKRFYSAEEAAAHCMASSSEQTSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1056 - protein, 589 aa, Artificial sequence
  Synthetic
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1057 - protein, 589 aa, Artificial sequence
  Synthetic
MAKRFYSAEEAAAHCSASSSEEFSGSDSEYVPPASESDSSTEESWCSSSTVSALEEPMEVDEDVDDLEDQEAHDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLHRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 1058 - protein, 589 aa, Artificial sequence
  Synthetic
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRKPCFEIYHTQLHY

SEQ ID NO: 1059 - protein, 589 aa, Artificial sequence
  Synthetic
MAKRFYSAEEAAAHCSASSSEQFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRGDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1060 - protein, 589 aa, Artificial sequence
  Synthetic
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWHPTDIAEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYMSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 1061 - protein, 589 aa, Artificial sequence
  Synthetic
MAKRFYSAEEAAAHCMASSSEEFYGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFKQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPDSDNVARLIGKHFIDTLPPTPGKQRPQKGCKVCRKRGIRRDTRYYCPKCPRNPGLCRIPCFEIYHTQLHY

SEQ ID NO: 1062 - protein, 589 aa, Artificial sequence
  Synthetic
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDICEMKRFVGLTLAMGLIKANSIESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYVLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1063 - protein, 589 aa, Artificial sequence
  Synthetic
MAKRFYSAEEAAAHCSASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1064 - protein, 589 aa, Artificial sequence
  Synthetic
MAKRFYSAEEAAAHCSASSSDEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRGARAHAWYPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLMLFKGRLQFRQYIPSKRARYGIKFYKLCESSTGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRKPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDSVARLIGKHFIDTLPPTPGKQRPQKGCKVCRKRGIRRDTRYYCPKCPRNPGLCRKPCFEIYHTQLHY

SEQ ID NO: 1065 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFGATMSRNRYQLLLRFLHFNNNATAVPPDQPGHDRLHKLRPLIDSLSERFANVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1066 - protein, 589 aa, Artificial sequence
  Synthetic
MAKRFYSAEEAAAHCMASSSEETSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRHGRPPKNKPLCSKEYSKYMGGVDRADQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1067 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1068 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1069 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCRKPCFEIYHTQLHY

SEQ ID NO: 1070 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLKIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLNTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRHWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHY

SEQ ID NO: 1071 - protein, 589 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQQLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDRKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQYHY

SEQ ID NO: 1072 - protein, 589 aa, Artificial sequence
  Synthetic
MAKRFYSAEEAAAHCMASSSEEPSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTHLYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQYHY

SEQ ID NO: 1073 - protein, 592 aa, Artificial sequence
  Synthetic
MAKRFYSAEEAAAHCMASSQEEFSGSDSEYVPPASESDSSTEESWCSSSTVSALEEPMEVDEDVDDLEDQEAGDRVDAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKKNSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1074 - protein, 592 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNKLPRYARAHAWHPTDIAEMKRFVGLTLAMGLIKANSLESYWDTGTVHSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1075 - protein, 592 aa, Artificial sequence
  Synthetic
MAKRFCSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNPLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIATLPPTPGKQRPQKGCKVCRKRGIRRDTRYYCPKCPRNPGLCFKPCFEIYHTQLHYGRR

SEQ ID NO: 1076 - protein, 592 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLTRYARAHAWHPTDIAEMKRFVGLTLAMGLIKKNSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1077 - protein, 592 aa, Artificial sequence
  Synthetic
MAKRFYSAEEAAAHCMASSSEEFSGSDQEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNKLTRYARAHAWHPTDIAEMKRFVGLTLAMGLIKANSLESYWDTTTVLSIPVFSATMSRNRYQLLLRFLHFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1078 - protein, 592 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQNVLPRYARAHAWHPTDIAEMKRFVGLTLAMGLIKANSLESYWDTTTVLSIPVFSATMSRNRYQLLLRFLHFNNDATAVPPDQPGHDRLHKLRPLIDSLTERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1079 - protein, 592 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAPGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLSIPVFSATMSRNRYQLLLRFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1080 - protein, 592 aa, Artificial sequence
  Synthetic
MAKRFYSAEEAAAHCMASSSEEFSGSDSEYVPPASESDSSTEESWCSSSTVSALEEPMEVDEDVDDLEDQEAGDRVDAAAGGEPAWGPPCNFPPEIPPFTTVPGVKVDTSNFEPINFFQLFMTEAILQDMVLYTNVYAEQYLTQNPLPRYARAHAWHPTDIAEMKRFVGLTLAMGLIKANSLESYWDTTTVLSIPVFSATMSRNRYQLLLKFLHFNNEATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1081 - protein, 592 aa, Artificial sequence
  Synthetic
MAKRFYSAEEAAAHCMASSSEEFSGSDSEYVPPASESDSSTEESWCSSSTVSALEEPMEVDEDVDDLEDQEAGDRADAAAGGEPAWGPPCNFPPEIPPFTTVPGVKVDTSNFEPINFFQLFMTEAILQDMVLYTNVYAEQYLTQVPLPRYARAHAWHPTDIAEMKRFVGLTLAMGLIKANSLESYWDTTTVLNIPVFSATMSRNRYQLLLRFLEFNNNATAVPPDQPGHDRLHKLRPLIDSLSERFAAVYTPCQNICIDESLLLFKGRLQFRQYIPSKRARYGIKFYKLCESSSGYTSYFLIYEGKDSKLDPPGCPPDLTVSGKIVWELISPLLGQGFHLYVDNFYSSIPLFTALYCLDTPACGTINRNRKGLPRALLDKKLNRGETYALRKNELLAIKFFDKKNVFMLTSIHDESVIREQRVGRPPKNKPLCSKEYSKYMGGVDRTDQLQHYYNATRKTRAWYKKVGIYLIQMALRNSYIVYKAAVPGPKLSYYKYQLQILPALLFGGVEEQTVPEMPPSDNVARLIGKHFIDTLPPTPGKQRPQKGCKVCRKRGIRRDTRYYCPKCPRNPGLCFKPCFEIYHTQLHYGRR

SEQ ID NO: 1082 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1083 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYEVMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAHLDSSL

SEQ ID NO: 1084 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRERASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIKEHLHSRNKKKNIPTYLRQRIEKQLGEPSPRHVNVPGRYVRCQDCPYKKDRKTKRSCNACAKPICMEHAKFLCENCAELDSSI

SEQ ID NO: 1085 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRAVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRCNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1086 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQMSGPHYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSHL

SEQ ID NO: 1087 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSASTSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIAMQLGEPSPRHVNVPGRYVRCQDCPYKKDRKTKRSCNACAKPICMEHAKFLCENCAELDSSL

SEQ ID NO: 1088 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLLNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKTQIPENFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1089 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIKEHLHSRNKKKNIPTYLRQRIEKQLGEPSPRHVNYPGRYVRCQDCPYKKDRKTKRSCNACAKPICMEHAKFLCENCAELDSSL

SEQ ID NO: 1090 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1091 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRWRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIKEHLHSRNKKKNIPTYLRQRIEKQLGEPSPRHVNYPGRYVRCQDCPYKKDRKTKRSCNACAKPICMEHAKFLCENCAELHSSL

SEQ ID NO: 1092 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTSRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1093 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1094 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYIAGLIKSNRQSLKDLYRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELQANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 1095 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYIAGLIKSNRQSLKDLWRKDGTGVDIFRTTMSLQRFQFLLNNIRFDDISTRDERKQTDNMAAFRSIFDQFVQCCQNAYSPSEFLTIDEMLLSFRGRCLFRVYIPNKPAKYGIKILALVDAKNFYVHNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKKWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1096 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYIAGLIKSNRQSLKDLWRTDGTGVDIFRTTMSLQRFQFLINNIRFDDKSTRDERKQTDNMAAFRSIFDQFVQCCQNAYSPSEFLTIDEMLLSFRGRCLFRVYIPNKPAKYGIKILALVDAKNWYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1097 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSAKDLWRTDGTGVDIFRTTMSLQRFYFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1098 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLPELKALIALLYLAGLIKSNRQSLKDLWRTDGTGVDVFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1099 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRERQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVKNLEVYVGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1100 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDISTRDERKQTDNMAAFRSIFDQFVQCCQNAYSPSEFLTIDEMLLSFRGRCLFRVYIPNKPAKYGIKILALVDAKNDYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 1101 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLYRTDGTGVDIFRTTMSLQRFGFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNVPGRYVRCQDCPYKKDRKTKRSCNACAKPICMEHAKFLCENCAELDSSL

SEQ ID NO: 1102 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTILRQRIEKQLGEPSPRHVNVPGRYVRCQDCPYKKDRKTKRSCNACAKPICMEHAKFLCVNCAELDSSL

SEQ ID NO: 1103 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIGLLYLAGLIKSNRQSLKDLWRTDGTGVDIFRTTMSLQRFQFLQNNIRFDDKSTRDERKQTDNMAAFRSIFDQFVQSCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYELMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEKQLGEPSPRHVNYPGRYVRCQDCPYKKDRKTKRSCNACAKPICMEHAKFLCENCAELDSSL

SEQ ID NO: 1104 - protein, 610 aa, Artificial sequence
  Synthetic
MDIERQEERIRAMLEEELSDYSDESSSEDETDHCSEHEVNYDTEEERIDSVDVPSNSRQEEANAIIANESDSDPDDDLPLSLVRQRASASRQVSGPFYTSKDGTKWYKNCQRPNVRLRSENIVTEQAQVKNIARDASTEYECWNIFVTSDMLQEILTHTNSSIRHRQTKTAAENSSAETSFYMQETTLCELKALIALLYLAGLIKSNRQSLKDLWRTDGTGVDIFRTTMSLQRFQFLQNNIRFDDKSTRDERKQTDNMAAFRSIFDQFVQCCQNAYSPSEFLTIDEMLLSFRGRCLFRVYIPNKPAKYGIKILALVDAKNFYVVNLEVYAGKQPSGPYAVSNRPFEVVERLIQPVARSHRNVTFDNWFTGYECMLHLLNEYRLTSVGTVRKNKRQIPESFIRTDRQPNSSVFGFQKDITLVSYAPKKNKVVVVMSTMHHDNSIDESTGEKQKPEMITFYNSTKAGVDVVDELCANYNVSRNSKRWPMTLFYGVLNMAAINACIIYRTNKNVTIKRTEFIRSLGLSMIYEHLHSRNKKKNIPTYLRQRIEMQLGEPSPRHVNVPGRYVRCQDCPYKKDRKTKRSCNACAKPICMEHAKFLCENCAELKSSL

SEQ ID NO: 1105 - protein, 588 aa, Artificial sequence
  Synthetic
MARGLTDLEINQILELEDVENDVIFDESGDESDHVSIRVESDTEEVEIPTLEPQQGSSDSENDQPLSNLARRSFYKGKDNTIWNRAPPNPRVRTRSENIVTGTPGVKRQAKNALLELDCFHLFVNESILSVILEHTNHKIRSERQGKNTSNEYAYSETTLTELRAVIGLLYLAGLFKSGRQNLQDLWASDGTGIEIFPMTMSLRRFAFIVNCLRFDDSDTREERAAIDRLAPIRQIYEEFVKNCKDVYTPYENLTIDEELVAFRGRCKFRQYLPNKPAKYGIKIIALVDAYTYYSLNMEIYAGDQPDGPYKVSNKPHDVVDRIVQPISQTGRNVTMDNWFTSYPTYAHLLKNHKLTAVGTMKSNKTCIPPKFRERREINTSLFGFQDDFTIVSYIPKRNKNVFMLSSLHHDSEIDSETGEQQKPSIITFYNKTKSGVDNVDKLIRTYDVSRNSRRWPLTIFFWILNTAGINAKIVQMLNSSDNTPTRRAFIKKLGMSLIAPHQAERKTNSKIPVSLRKRIGSHLGESSASPAKIPNVGVKKRCYICPVKKDRKSKYICISCTSHICLEHANFVCENCRRNEEENSDSS

SEQ ID NO: 1106 - protein, 613 aa, Artificial sequence
  Synthetic
MEPSTSSGRKRSIGNVHNQRAAKNRRAVVPGTRDFGTTLTSWLDNEDSSGSEVEDIGDNFTPERHEIESDTISQSESEEQVADHVTEEHNMSSDDDAPLSTRRSFYGKNRYKWACQPLSRAVRVPQHNIIQRTNVSNLTEDDPKDPFSIWNKLMDDEILQETLKWTNEKIIQYRSKFSDKDRPELRNLDMVELHAFIGLLLFTAVFKSNHENVNYLFATDGTGREIFRCVMSKNRFLVILHCLRFDNPDDREERRESDKIAAISYIFTKFVGNCQKIYNVCEYATVDEMLVPFRGRTHLMIYMPMKPAKYGLKLMCLCDANNGYFYNCYIYTGRGSDGAGLTEEEKKFMVPTQSVIHLAKPLFGSNRNITCDNWFTSIELIEYLKKKGLTCVGTMKKNKREIPKEFLPSKQRDVGSSLYGYAGQNTILSHVPKKNKAVILLSSMHHAEAVDETTGKPEIIGFYNKTKGGVDEIDKKCAIYTSSRRTRRWPMVVFYRMLDISTVNSHLIYDIHHDKTTERGMFLKQLARTLVLPQMKRRALNERLPRELRLSLARVLGPDMPVPDPQEVDETFKTRRRCHTCPLKLQRKSTHTCYTCKKHVCLQCAKQVCADCV

SEQ ID NO: 1107 - protein, 579 aa, Artificial sequence
  Synthetic
MSSRRFTAEEALLLFFDSDAEEEISEIEDLSDAEDNDIDDPDFQFSDDEEDSEDESAVVSPSDENLGMEQSSSTEGTWASKDGNIKWSTSPHQSRGRLSSSNIIKMTPGPTRFAVTRVDDIQSAFQLFISQPIERIILDMTNLEGRRVFQEKWKSLDQTDLNAYIGILILAGVYRSKGEATSSLWNEENGRPIFRATMSLETFHMISRVIRFDNRDTRVGRRESDKLAAIRDVWDKWVEILPLLYNPGPHVTVDERLVPFRGRCPFRQYMPNKPAKYGIKIWAACDAKSSYAWKMQVYTGKSPGGAPEKNQGMRVVLEMSEGLQGHNITCDNFFTSYRLGEELQKRKLTMLGTVRRNKPELPSEILKIQGRPMHSSIFAFTEKATVVSYCPKRNKNVLVMSTMHTDASLSTRDDMKPQMILDYNSTKGGVDNLDKVTATYSCQRKTARWPMAIFFNIVDVSAYNAYVLWSEINQEWNAGKLYRRRLFLEELGKALITPKIQRRARPARSPAAAAVIEKIKFRTSNQFAMDPVDTDVKKRKRCQVCPSRDDSKTSTSCVKCKNFICRKHTVTFCPSCGEH

SEQ ID NO: 1108 - protein, 598 aa, Artificial sequence
  Synthetic
MESRQRLNQDEIATILENDDDYSPLDSDSEAEDRVVEDDVWSDNEDAMIDYVEDTSRQEDPDNNIASQESANLEVTSLTSHRIISLPQRSICGKNNHVWSTTKGRTTGRTSAINIIRTNRGPTRMCRNIVDPLLCFQLFITDEIIHEIVKWTNVEMIVKRQNLIDISASYRDTNTMEMWALVGILTLTAVMKDNHLSTDELFDATFSGTRYVSVMSRERFEFLIRCMRMDDKTLRPTLRSDDAFIPVRKLWEIFINQCRLNYVPGGNLTVDEQLLGFRGRCPFRMYIPNKPDKYGIRFPMMCDAATKYMIDAIPYLGKSTKTNGLPLGEFYVKELTKTVHGTNRNVTCDNWFTSIPLAKNMLQAPYNLTIVGTIRSNKREIPEEIKNSRSRPVGSSMFCFDGPLTLVSYKPKPSRMVFLLSSCDENAVINESNGKPDMILFYNQTKGGVDSFDQMCKSMSANRKTNRWPMAVFYGMLNMAFVNSYIIYCHNKINKQKKPINRKEFMKNLSTDLTTPWMQERLKAPTLKRTLRDNITNVLKNVVPPSPANNSEEPGPKKRSYCGFCSYKKRRMTKTQFYKCKKAICGEHNIDVCQDCVG

SEQ ID NO: 1109 - protein, 598 aa, Artificial sequence
  Synthetic
MASRQRLNHDEIATILENDDDYSPLDSESEKEDCVVEDDVWSDNEDAIVDFVEDTSAQEDPDNNIASRESPNLEVTSLTSHRIITLPQRSIRGKNNHVWSTTKGRTTGRTSAINIIRTNRGPTRMCRNIVDPLLCFQLFITDEIIHEIVKWTNVEIIVKRQNLKDISASYRDTNTMEIWALVGILTLTAVMKDNHLSTDELFDATFSGTRYVSVMSRERFEFLIRCIRMDDKTLRPTLRSDDAFLPVRKIWEIFINQCRQNHVPGSNLTVDEQLLGFRGRCPFRMYIPNKPDKYGIKFPMMCAAATKYMIDAIPYLGKSTKTNGLPLGEFYVKDLTKTVHGTNRNITCDNWFTSIPLAKNMLQAPYNLTIVGTIRSNKREMPEEIKNSRSRPVGSSMFCFDGPLTLVSYKPKPSKMVFLLSSCDENAVINESNGKPDMILFYNQTKGGVDSFDQMCKSMSANRKTNRWPMAVFYGMLNMAFVNSYIIYCHNKINKQEKPISRKEFMKKLSIQLTTPWMQERLQAPTLKRTLRDNITNVLKNVVPASSENISNEPEPKKRRYCGVCSYKKRRMTKAQCCKCKKAICGEHNIDVCQDCIG

SEQ ID NO: 1110 - DNA, 328 bp, Artificial sequence
  Synthetic
cagtgttcttcaacctgtgttccgcggaaccctagggttccacccaaaggctttcggggttccgcgagtcattgcttcaattcgagagacgtcggccgcgccgctcttcagaatgcacatgcgtcaatcggagtttcatgttgaaacatgttatccattcgcatagttgacttacactgcacttaaccttaattttcaaaaatatgtaactgtacttgtggtcgtagttttgttgttgttttaggtttagacaagcaaaggtaagttaacttacagttttaaaataaattgtattttgtttgatcctaacctagaatcgttcagaaat

SEQ ID NO: 1111 - DNA, 145 bp, Artificial sequence
  Synthetic
ccaaagcacgggctcaccttgttcgtaacaagtcaacgcagctgtccctaaaatctcatctgggtgtattactaaatgaagggttccataaaaaaaaatatctcgacaaagggttccgccggatggcaaaggttgaagaacactg

SEQ ID NO: 1112 - DNA, 16 bp, Artificial sequence
  Synthetic
cagtgttcttcaacct

SEQ ID NO: 1113 - DNA, 16 bp, Artificial sequence
  Synthetic
aggttgaagaacactg

SEQ ID NO: 1114 - protein, 636 aa, Artificial sequence
  Synthetic
MMLNWLKSGKLESQSQEQSSCYLENSNCLPPTLDSTDIIGEENKAGTTSRKKRKYDEDYLNFGFTWTGDKDEPNGLCVICEQVVNNSSLNPAKLKRHLDTKHPTLKGKSEYFKRKCNELNQKKHTFERYVRDDNKNLLKASYLVSLRIAKQGEAYTIAEKLIKPCTKDLTTCVFGEKFASKVDLVPLSDTTISRRIEDMSYFCEAVLVNRLKNAKCGFTLQMDESTDVAGLAILLVFVRYIHESSFEEDMLFCKALPTQTTGEEIFNLLNAYFEKHSIPWNLCYHICTDGAKAMVGVIKGVIARIKKLVPDIKASHCCLHRHALAVKRIPNALHEVLNDAVKMINFIKSRPLNARVFALLCDDLGSLHKNLLLHTEVRWLSRGKVLTRFWELRDEIRIFFNEREFAGKLNDTSWLQNLAYIADIFSYLNEVNLSLQGPNSTIFKVNSRINSIKSKLKLWEECITKNNTECFANLNDFLETSNTALDPNLKSNILEHLNGLKNTFLEYFPPTCNNISWVENPFNECGNVDTLPIKEREQLIDIRTDTTLKSSFVPDGIGPFWIKLMDEFPEISKRAVKELMPFVTTYLCEKSFSVYVATKTKYRNRLDAEDDMRLQLTTIHPDIDNLCNNKQAQKSH

SEQ ID NO: 1115 - DNA, 181 bp, Artificial sequence
  Synthetic
gggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 1116 - DNA, 181 bp, Artificial sequence
  Synthetic
gagtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagca

SEQ ID NO: 1117 - DNA, 145 bp, Artificial sequence
  Synthetic
ttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcct

SEQ ID NO: 1118 - DNA, 145 bp, Artificial sequence
  Synthetic
ttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 1119 - DNA, 168 bp, Artificial sequence
  Synthetic
gcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgta

SEQ ID NO: 1120 - DNA, 185 bp, Artificial sequence
  Synthetic
ttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttccttgtagttaatgattaacccgccatgctacttatctacgta

SEQ ID NO: 1121 - DNA, 128 bp, Artificial sequence
  Synthetic
gcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 1122 - DNA, 145 bp, Artificial sequence
  Synthetic
ttgcccactccctctatgcgcgctcgctcgctcggtggggcctgcggaccaaaggtccgcagacggcagagctctgctctgccggccccaccgagcgagcgagcgcgcatagagggagtgggcaactccatcactaggggtattc

SEQ ID NO: 1123 - DNA, 104 bp, Artificial sequence
  Synthetic
gcgcgctcgctcgctcactgaggccgcccgggcaaagcccgggcgtcgggcgacctttggtcgcccggcctcagtgagcgagcgagcgcgcagagagggagtgg

SEQ ID NO: 1124 - protein, 21 aa, Artificial sequence
  Synthetic
FLFVLLGVGSMGVAAIVWGAW

SEQ ID NO: 1125 - protein, 21 aa, Artificial sequence
  Synthetic
FWLPIGCAAFVVVCILGCILI

SEQ ID NO: 1126 - protein, 21 aa, Artificial sequence
  Synthetic
ILVIFSGMFLVFTLAGALFLH

SEQ ID NO: 1127 - protein, 21 aa, Artificial sequence
  Synthetic
GGTVLLLLFVISITTIIVIFL

SEQ ID NO: 1128 - protein, 21 aa, Artificial sequence
  Synthetic
WAVYAGLLGGVIMILIMVVIL

SEQ ID NO: 1129 - protein, 21 aa, Artificial sequence
  Synthetic
IYAGVCISVLVLLALLGVIIA

SEQ ID NO: 1130 - protein, 21 aa, Artificial sequence
  Synthetic
IWLIVGICIALFALPFVIYAA

SEQ ID NO: 1131 - protein, 21 aa, Artificial sequence
  Synthetic
IGGIITVFLIALVLTSTIVTL

SEQ ID NO: 1132 - protein, 21 aa, Artificial sequence
  Synthetic
VAAILGLGLVLGLLGPLAILL

SEQ ID NO: 1133 - protein, 22 aa, Artificial sequence
  Synthetic
ALVVIPIIFGILFAILLVLVFI

SEQ ID NO: 1134 - protein, 27 aa, Artificial sequence
  Synthetic
IISFFLALTSTALLFLLFFLTLRFSVV

SEQ ID NO: 1135 - protein, 21 aa, Artificial sequence
  Synthetic
GLIILLLFASVALVAAIIFGV

SEQ ID NO: 1136 - protein, 21 aa, Artificial sequence
  Synthetic
TLGLCLCAVLCCFLVAVACFL

SEQ ID NO: 1137 - protein, 21 aa, Artificial sequence
  Synthetic
FGAPALLGLALVLALVLVGLV

SEQ ID NO: 1138 - protein, 21 aa, Artificial sequence
  Synthetic
WWFLSGSLVIVIVCSTVGLII

SEQ ID NO: 1139 - protein, 23 aa, Artificial sequence
  Synthetic
ILWTCLGLSLIISLAVFVLMFLL

SEQ ID NO: 1140 - protein, 21 aa, Artificial sequence
  Synthetic
LGWLTVVLLAVAACVLLLTSA

SEQ ID NO: 1141 - protein, 21 aa, Artificial sequence
  Synthetic
FLLWILAAVSSGLFFYSFLLT

SEQ ID NO: 1142 - protein, 23 aa, Artificial sequence
  Synthetic
IAAIVGGTVAGIVLIGILLLVIW

SEQ ID NO: 1143 - protein, 17 aa, Artificial sequence
  Synthetic
LGWLCLLLLPIPLIVWV

SEQ ID NO: 1144 - protein, 28 aa, Artificial sequence
  Synthetic
PVLDAGPVLFWVILVLVVVVGSSAFLLC

SEQ ID NO: 1145 - protein, 23 aa, Artificial sequence
  Synthetic
IWVILVVTLVVPLLLVAVLIVCC

SEQ ID NO: 1146 - protein, 21 aa, Artificial sequence
  Synthetic
LSGIIIGVTVAAVVLIVAVFV

SEQ ID NO: 1147 - protein, 21 aa, Artificial sequence
  Synthetic
AAVICSALATVLLALLILCVI

SEQ ID NO: 1148 - protein, 21 aa, Artificial sequence
  Synthetic
LPWMIVLFLLLVLVVIVVCSI

SEQ ID NO: 1149 - protein, 21 aa, Artificial sequence
  Synthetic
MFWVQVLLAGLVVPLLLGATL

SEQ ID NO: 1150 - protein, 20 aa, Artificial sequence
  Synthetic
YIWAPLAGTCGVLLLSLVIT

SEQ ID NO: 1151 - protein, 36 aa, Artificial sequence
  Synthetic
RDQRLPPDAHKPPGGGSFRTPIQEEQADAHSTLAKI

SEQ ID NO: 1152 - protein, 62 aa, Artificial sequence
  Synthetic
KKVAKKPTNKAPHPKQEPQEINFPDDLPGSNTAAPVQETLHGCQPVTQEDGKESRISVQERQ

SEQ ID NO: 1153 - protein, 48 aa, Artificial sequence
  Synthetic
QRRKYRSNKGESPVEPAEPCHYSCPREEEGSTIPIQEDYRKPEPACSP

SEQ ID NO: 1154 - protein, 42 aa, Artificial sequence
  Synthetic
KRGRKKLLYIFKQPFMRPVQTTQEEDGCSCRFPEEEEGGCEL

SEQ ID NO: 1155 - protein, 383 aa, Artificial sequence
  Synthetic
CYRKKGKALTANLWHWINEACGRLSGDKESSGDSCVSTHTANFGQQGACEGVLLLTLEEKTFPEDMCYPDQGGVCQGTCVGGGPYAQGEDARMLSLVSKTEIEEDSFRQMPTEDEYMDRPSQPTDQLLFLTEPGSKSTPPFSEPLEVGENDSLSQCFTGTQSTVGSESCNCTEPLCRTDWTPMSSENYLQKEVDSGHCPHWAASPSPNWADVCTGCRNPPGEDCEPLVGSPKRGPLPQCAYGMGLPPEEEASRTEARDQPEDGADGRLPSSARAGAGSGSSPGGQSPASGNVTGNSNSTFISSGQVMNFKGDIIVVYVSQTSQEGAAAAAEPMGRPVQEETLARRDSFAGNGPRFPDPCGGPEGLREPEKASRPVQEQGGAKA

SEQ ID NO: 1156 - protein, 107 aa, Artificial sequence
  Synthetic
KKRGDPCSCQPRSRPRQSPAKSSQDHAMEAGSPVSTSPEPVETCSFCFPECRAPTQESAVTPGTPDPTCAGRWGCHTRTTVLQPCPHIPDSGLGIVCVPAQEGGPGA

SEQ ID NO: 1157 - protein, 85 aa, Artificial sequence
  Synthetic
SWRRRQRRLRGASSAEAPDGDKDAPEPLDKVIILSPGISDATAPAWPPPGEDPGTTPPGHSVPVPATELGSTELVTTKTAGPEQQ

SEQ ID NO: 1158 - protein, 60 aa, Artificial sequence
  Synthetic
CVKRRKPRGDVVKVIVSVQRKRQEAEGEATVIEALQAPPDVTTVAVEETIPSFTGRSPNH

SEQ ID NO: 1159 - protein, 107 aa, Artificial sequence
  Synthetic
RKINSEPLKDEFKNTGSGLLGMANIDLEKSRTGDEIILPRGLEYTVEECTCEDCIKSKPKVDSDHCFPLPAMEEGATILVTTKTNDYCKSLPAALSATEIEKSISAR

SEQ ID NO: 1160 - protein, 58 aa, Artificial sequence
  Synthetic
QLGLHIWQLRSQCMWPRETQLLLEVPPSTEDARSCQFPEEERGERSAEEKGRLGDLWV

SEQ ID NO: 1161 - protein, 41 aa, Artificial sequence
  Synthetic
RSKRSRLLHSDYMNMTPRRPGPTRKHYQPYAPPRDFAAYRS

SEQ ID NO: 1162 - protein, 41 aa, Artificial sequence
  Synthetic
RSKRSRLLHSDYMNMPPRRPGPTRKHYQPYAPPRDFAAYRS

SEQ ID NO: 1163 - protein, 111 aa, Artificial sequence
  Synthetic
FWGRRSCQQRDSGNSPGNAFYSNVLYRPRGAPKKSEDCSGEGKDQRGQSIYSTSFPQPAPRQPHLASRPCPSPRPCPSPRPGHPVSMVRVSPRPSPTQQPRPKGFPKVGEE

SEQ ID NO: 1164 - protein, 35 aa, Artificial sequence
  Synthetic
TKKKYSSSVHDPNGEYMFMRAVNTAKKSRLTDVTL

SEQ ID NO: 1165 - protein, 61 aa, Artificial sequence
  Synthetic
NRRRRRERRDLFTESWDTQKAPNNYRSPISTSQPTNQSMDDTREDIYVNYPTFSRRPKTRV

SEQ ID NO: 1166 - protein, 77 aa, Artificial sequence
  Synthetic
QLRRRGKTNHYQTTVEKKSLTIYAQVQKPGPLQKKLDSFPAQDPCTTIYVAATEPVPESVQETNSITVYASVTLPES

SEQ ID NO: 1167 - protein, 48 aa, Artificial sequence
  Synthetic
KKYFFKKEVQQLSVSFSSLQIKALQNAVEKEVQAEDNIYIENSLYATD

SEQ ID NO: 1168 - protein, 100 aa, Artificial sequence
  Synthetic
KVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 1169 - protein, 251 aa, Artificial sequence
  Synthetic
KWIGYICLRNSLPKVLNFHNFLAWPFPNLPPLEAMDMVEVIYINRKKKVWDYNYDDESDSDTEAAPRTSGGGYTMHGLTVRPLGQASATSTESQLIDPESEEEPDLPEVDVELPTMPKDSPQQLELLSGPCERRKSPLQDPFPEEDYSSTEGSGGRITFNVDLNSVFLRVLDDEDSDDLEAPLMLSSHLEEMVDPEDPDNVQSNHLLASGEGTQPTFPSPSSEGLWSEDAPSDQSDTSESDVDLGDGYIMR

SEQ ID NO: 1170 - protein, 286 aa, Artificial sequence
  Synthetic
NCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 1171 - protein, 86 aa, Artificial sequence
  Synthetic
ERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 1172 - protein, 111 aa, Artificial sequence
  Synthetic
VKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1173 - DNA, 22 bp, Artificial sequence
  Synthetic
tttgtctgtaaatagttccagt

SEQ ID NO: 1174 - DNA, 22 bp, Artificial sequence
  Synthetic
actggaactacttacagacaac

SEQ ID NO: 1175 - DNA, 22 bp, Artificial sequence
  Synthetic
tttgacaccctgatgaacctgt

SEQ ID NO: 1176 - DNA, 22 bp, Artificial sequence
  Synthetic
acaggttcataagggtgtcaac

SEQ ID NO: 1177 - DNA, 22 bp, Artificial sequence
  Synthetic
ataggtaacactataatccttc

SEQ ID NO: 1178 - DNA, 22 bp, Artificial sequence
  Synthetic
gaaggattatcgtgttacctac

SEQ ID NO: 1179 - DNA, 681 bp, Artificial sequence
  Synthetic
atctgatcttctgaagaaaatatatttctttttattcatagctcttaactagtggtgatagcaatgtcagcagtgccttttgtctgtaaatagttccagtgtgaagccacagatgactggaactacttacagacaacaagtaaggttgaccatactctactctagttatattctttaggcacgaatgtgtgtttaaaaaaaataaaaactagtggtgatagcaatgtcagcagtgccttttgacaccctgatgaacctgtgtgaagccacagatgacaggttcataagggtgtcaacaagtaaggttgaccatactctactctagagttgtgttttaatgtatattaatgttactaatgtgtttactagtggtgatagcaatgtcagcagtgcctataggtaacactataatccttcgtgaagccacagatggaaggattatcgtgttacctacaagtaaggttgaccatactctactctaggttatttttagtatgattctgtaaaaatgaattaatactaactagtggtgatagcaatgtcagcagtgcctttttacttggtgtttatgcagggtgaagccacagatgcctgcataaaaaccaagtaaacaagtaaggttgaccatactctactctagtcagttttattgatagtcttttcagtattattgataatctt

SEQ ID NO: 1180 - DNA, 2235 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgagagcagcggccgggaaggggcggtgcgggaggcggggtgtggggcggtagtgtgggccctgttcctgcccgcgcggtgttccgcattctgcaagcctccggagcgcacgtccgtctcaggggcagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagcttaattaagatccttttccctctgaccagaattatgggaacatcatgaagccccttgagcatctagcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 1181 - DNA, 3221 bp, Artificial sequence
  Synthetic
caacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 1182 - DNA, 2264 bp, Artificial sequence
  Synthetic
cggggttggggttgcgccttttccaaggcagccctgggtttgcgcagggacgcggctgctctgggcgtggttccgggaaacgcagcggcgccgaccctgggcctcgcacattcttcacgtccgttcgcagcgtcacccggatcttcgccgctacccttgtgggccccccggcgacgcttcctcgtccgcccctaagtcgggaaggttccttgcggttcgcggcgtgccggacgtgacaaacggaagccgcacgactcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtccgtctcaggggagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 1183 - DNA, 3089 bp, Artificial sequence
  Synthetic
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcggactcttccgccgcagccgccgccatcgtcggcgcgcttccctgttcacctctgtatttgagaatccgacgccatctgccaccaggtgagtgtccgcggcgcggcaagacttggggactgtgacgagacttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggtgacctctagtgagctgagcctcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtcacagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacaggtgaacttcgtctcaggggagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatc

SEQ ID NO: 1184 - DNA, 7456 bp, Artificial sequence
  Synthetic
ttaaccctcatattatgttaagggtcaatttgacccatttcagtttttggtttgaccaaagaactggttatcctttctttttcttcacgaaagttggtgacttttcctcatctagggtcatgaacttgtgtgtaaaatctggatactgtgaagtgtcgtggaatgtctgtgaacagtttgtatacaaagatgatgttgcgggtcattttgacccacacactttgatgtgagcaagtagctgtccagatccgaaataaacatgtctctttgatgcactttattttgattgctaaattatttatattttgactgtctctgaatagaccttcagatcagagactcaggtgtgtgtgggggaggagctttctctcccttgtccttgtcactgttctcgtgtcatctctttgagaaacagcaaaactgtctaactggtccgatccttaacctttaactgctgaggtgggggcttttcgagcctagcgaaagtgaaattgttcccctcctcccttcccccgcgcgcgacaaacccgtaacttctagtagcttcgatgttagttgcgcctaggccgtcagaagcttcgcacgtgttttcgtgcgcaattcggtaagtaaattcaatttgaaatttgtcgcgggcttcttaggccccacctcagtgtttacgtaacttttttgtaaatagtttcgattaagttattgtgttttttttttgcagtagcttgaaaacgtttgaaaaggctgagttgacgtatctgtttaacccttggcatgcctggtagggtttattagacccaccactttgaaaaacctatgatatttttttaaattgaaggctattgttgacgtgtgttatagtagcttcgcgcaataaaccggcggccattttgacgagcgaacttcagtctcacgtgagcgtgcgtgcgagtagcacgtgtgtaaagtgcgcgcgggcccgtgggaccctaccaggcatacaacgtaacattctgtcggtaagaatattttctttattttttggcatttctttgtttaatgtgttaaattataatacgaaaaaaatattgttgcagtagaagctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtaagcaggttttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcatcagaagaactcgtcaagaaggcgatagaaggcgatgcgctgcgaatcgggagcggcgataccgtaaagcacgaggaagcggtcagcccattcgccgccaagttcctcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgttcctcgtccagatcatcctgatcgacaagaccggcttccatccgagtacgtgctcgctcgatgcgatgtttcgcttggtggtcgaatgggcatgtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaaccagcgtgcaatccatcttgttcaatcatgccaccctgcagagtcgctctgtgttcgaggccacacgcgtcaccttaatatgcgaagtggacctgggaccgcgccgccccgactgcatctgcgtgttttcgccaatgacaagacgctgggcggggtttgtgtcatcatagaactaaagacatgcaaatatatttcttccggggacaccgccagcaaacgcgagcaacgggccacggggatgaagcagctggaaacttgatctgtcgccgcaattcaaacttcgtgaggctccggtgcccgtcagtgacctgctatactctggagacgtctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgagagcagcggccgggaaggggcggtgcgggaggcggggtgtggggcggtagtgtgggccctgttcctgcccgcgcggtgttccgcattctgcaagcctccggagcgcacgtccgtctcaggggcagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagcttaattaagatccttttccctctgaccagaattatgggaacatcatgaagccccttgagcatctagcttctggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcagaaaattttgtgtcgcccttcgctgaacaccaggtgggccgcctactgcgcacgcgcgggtttgcgggcagccgcctgggctgtgggagcagcccgggcagagctctcctgcctctccaccagcccaccccgccgcctgaccgccccctccccaccccccaccccccacccccggaaaacgcgtcgtcccctgggctgggtggtgacccccgtcccgcgaaacaccgggccccgcgcagcgtccgggcctgacaccgctccggcggctcgcctcctatgcgcccccgcgccaccgtcgcccgcccgcccgggcccctgcagccgcccaggtgccagcacggagcgcctggcggcggaacgcagaccccaggcccggcgcacaccggggacgctgagcgttccaggcgggagggaaggcgggcagagatggagagaggaacgggagtcctagaggggcggaaggacgggcggagggacgttaggagggagggagggaggcagggaggcagggaggaacggagggaaagacagagcgacgcagggactgggggcgggcgggagggagccggggaacggggggaggaaggcagggaggaaaagcggtcctcggcctccgggagtagcgggacccccgccctccgggaaaacggtcagcgtccggcgcgggctgagggctgggcccacagccgccgcgccggccggcggggcaccacccattcgccccggttccgtggcccagggagtgggcggtttcctccgggacaaaagaccgggactcgggttgccgtcgggtgttcacccgcgcggttcacagaccgcacatccccaggctgagccctgcaacgcggcgcgaggccgacagccccggccacggaggagccacacgcaggacgacggaggcgtgattttggtttccgcgtggctttgccctccgcaaggcggcctgttgctcaagtctctccggcccccgaaaggctggccatgccgactgtttgctcccggagctctgcgggcacccggaaacatgcagggaagggtgcaagcccggcacggtgccttcgctctccttgccaggttccaaaccggccacactgcagactccccacgttgccgcacgcgggaatccatcgtcaggccatcacgccggggaggcatctcctctctggggtgtcgctctggacttctacgtggaaatgaacgagagccacacgcctgcgtgtgccagaccgtcccggcaacggcgacgcccacaggcattgcctccttcacggagagagggcctggcacactcaagactcccacggaggttcagttccacactccacctaggagatactgaatattgaaaatctcagaaaatgtgacaagttaaattacaaaaaaaaagtgtttgtgaaggaaaaaaatattaaatatagtgttggaataaaaaaatagtattgtttgtctctttcctaaatgttgaaatattctaaaataaagttgatatcagtttaacctgtttttttattgttttgagtggatttacacagtatgggtcaaaatgacccgcaacataatcaaggtaattttttttcaacataatacgagggttaa

SEQ ID NO: 1185 - DNA, 7848 bp, Artificial sequence
  Synthetic
ttaacccggcgagcatgaggtgaaaaaaagttacatcaagaatgtggcagggtatgacatacccatattttgttgtactataatattgttcttattattatttactcaattatgttgatcttattttgtaaaataatggtttatttaatggcattcaatgaaagaagtttttaattatgaaattattattatttattaatctttttcttaaacacagtaattttagcaacaaacatttagaggtttacaaaaatcaacaatttaacaaaaatattattctttggaatataaatcaacctaatactgaaagataatgagattcttttcattataaaacatataattatttttttaaactaaaaatatgacctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagactactctggagacgcaacctttggagctaagccagcaatggtagagggaagattctgcacgtcccttccaggcggcctccccgtcaccaccccccccaacccgccccgaccggagctgagagtaattcatacaaaaggactcgcccctgccttggggaatcccagggaccgtcgttaaactcccactaacgtagaacccagagatcgctgcgttcccgccccctcacccgcccgctctcgtcatcactgaggtggagaatagcatgcgtgaggctccggtgcccgtcagtgggcagagcgcacatcgcccacagtccccgagaagttggggggaggggtcggcaattgaacgggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctccagtacgtgattcttgatcccgagctggagccaggggcgggccttgcgctttaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacgtgctgcgacgctttttttctggcaagatagtcttgtaaatgcgggccaggatctgcacactggtatttcggtttttgggcccgcggccggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctccagggggctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctggagcttttggagtacgtcgtctttaggttggggggaggggttttatgcgatggagtttccccacactgagtgggtggagactgaagttaggccagcttggcacttgatgtaattctccttggaatttggcctttttgagtttggatcttggttcattctcaagcctcagacagtggttcaaagtttttttcttccatttcaggtgtcgtgaacacgtctcaggggagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcacctgctcagtcagaaaatctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattcctagctttgatcaaaaactgaaaataataaaaaaaaactcaactaaaggaacgaaagacaaccgatacagtaaatcataaaaaaagaacaatggataacataaaaataccaataaaacagttgaaattaataatcggaaaaattacataaaaaaaatacgtcaacaatgaggcagggtataacatacccgaaacaggtttgcacacgaatatctcgccggtgtcccgtgccacactgcgatcacgccactatcccctcccgcacgctcctgcctccagctactgagcgcgctagtgttgtcagacgaaaattttataaaatacacaactttaaaattttaccagggtatgagataccctgcctcatgctcgccgggttaa

SEQ ID NO: 1186 - DNA, 6895 bp, Artificial sequence
  Synthetic
ttaacccggcgagcatgaggtgaaaaaaagttacatcaagaatgtggcagggtatgacatacccatattttgttgtactataatattgttcttattattatttactcaattatgttgatcttattttgtaaaataatggtttatttaatggcattcaatgaaagaagtttttaattatgaaattattattatttattaatctttttcttaaacacagtaattttagcaacaaacatttagaggtttacaaaaatcaacaatttaacaaaaatattattctttggaatataaatcaacctaatactgaaagataatgagattcttttcattataaaacatataattatttttttaaactaaaaatatgacctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagactactctggagacgattccggggttggggttgcgccttttccaaggcagccctgggtttgcgcagggacgcggctgctctgggcgtggttccgggaaacgcagcggcgccgaccctgggcctcgcacattcttcacgtccgttcgcagcgtcacccggatcttcgccgctacccttgtgggccccccggcgacgcttcctcgtccgcccctaagtcgggaaggttccttgcggttcgcggcgtgccggacgtgacaaacggaagccgcacgactcactagtaccctcgcagacggacagcgccagggagcaatggcagcgcgccgaccgcgatgggctgtggccaatagcggctgctcagcagggcgcgccgagagcagcggccgggaaggggcggtgcgggaggcggggtgtggggcggtagtgtgggccctgttcctgcccgcgcggtgttccgcattctgcaagcctccggagcgcacgtccgtctcaggggagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcacctgctcagtcagaaaatctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattcctagctttgatcaaaaactgaaaataataaaaaaaaactcaactaaaggaacgaaagacaaccgatacagtaaatcataaaaaaagaacaatggataacataaaaataccaataaaacagttgaaattaataatcggaaaaattacataaaaaaaatacgtcaacaatgaggcagggtataacatacccgaaacaggtttgcacacgaatatctcgccggtgtcccgtgccacactgcgatcacgccactatcccctcccgcacgctcctgcctccagctactgagcgcgctagtgttgtcagacgaaaattttataaaatacacaactttaaaattttaccagggtatgagataccctgcctcatgctcgccgggttaa

SEQ ID NO: 1187 - DNA, 7716 bp, Artificial sequence
  Synthetic
ttaacccggcgagcatgaggtgaaaaaaagttacatcaagaatgtggcagggtatgacatacccatattttgttgtactataatattgttcttattattatttactcaattatgttgatcttattttgtaaaataatggtttatttaatggcattcaatgaaagaagtttttaattatgaaattattattatttattaatctttttcttaaacacagtaattttagcaacaaacatttagaggtttacaaaaatcaacaatttaacaaaaatattattctttggaatataaatcaacctaatactgaaagataatgagattcttttcattataaaacatataattatttttttaaactaaaaatatgacctagcgcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattggtaccggggtgtggtgtcttctttctttatgttttaaatgcactgacctcccacattccctttttagtaaaatattcagaaataatttaaatacatcattgcaatgaaaataaatgttttttattaggcagaatccagatgctcaaggcccttcataatatcccccagtttagtagttggacttagggaacaaaggaacctttaatagaaattggacagcaagaaagcgagtcaggcaccgggcttgcgggtcatgcaccaggtgcgcggtccttcgggcacctcgacgtcggcggtgacggtgaagccgagccgctcgtagaaggggaggttgcggggcgcggatgtctccaggaaggcgggcaccccggcgcgctcggccgcctccactccggggagcacgacggcgctgcccagacccttgccctggtggtcgggcgacacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcggacgaaaggcccggagatgaggaagaggagaacagcgcggcagacgtgcgcttttgaagcgtgcagaatgccgggcctccggaggaccttcgggcgcccgccccgcccctgagcccgcccctgagcccgcccccggacccaccccttcccagcctctgagcccagaaagcgaaggagcaaagctgctattggccgctgccccaaaggcctacccgcttccattgctcagcggtgctgtccatctgcacgagactagtgagtcgtgctacttccatttgtcacgtcctgcacgacgcgagctgcggggcgggggggaacttcctgactaggggaggagtagaaggtggcgcgaaggggccaccaaagaacggagccggttggcgcctaccggtggatgtggaatgtgtgcgaggccagaggccacttgtgtagcgccaagtgcccagcggggctgctaaagcgcatgctccagactgccttgggaaaagcgcctcccctacccggtagagaaacttgatctgtcgccgcaattcaaacttcgtgaggctccggtgcccgtcagtggaagactactctggagacggggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcggactcttccgccgcagccgccgccatcgtcggcgcgcttccctgttcacctctgtatttgagaatccgacgccatctgccaccaggtgagtgtccgcggcgcggcaagacttggggactgtgacgagacttcggggcagcgggaggtggccggagcgggacccggaaaagaaaggagacatggctgcctctgcatgggtggcgggacgtggtcggctcgcggcgccatatctgcacctcctctgcccgtctttgggagtgtcggcctcctgaagttggagtgttttctctaattccttcgtccagctctcctttccgagaacgctggggtggctgtgggaggggcggcgtttgctgatgtggcagcggacataatgctgtatagccctgtgcccatggtgacagggtgatggtgctcccgggaagtgacagcctgcaggggtggctcacatggtgacctctagtgagctgagcctcttccgccctggcctttatctccttccttggtccgcacaatggaaccggtcccctccaagctgagaaaatggctcatgggcctaggggcctattgtggcctttgatcccagcatttgaccttggcgcacaaggcgggttggcagtgtgtagcaggcgaggttttgtcggcctgtgtgggccccatctcgtgcgggccccctgtcgcctgcattgttggactgctggggtggcagtccagcttggcgttgattacgtggtgcggtcacagcctaggctccctggtactcttgttctagttgtcattttggttagggttgggttcctgacacatctggtgactcttgatgcttcttaggtggtaggcttgtaggtgtgagtcgaatgagcgccagttttggggagacagctctttggaaccccacaatggggtgctatcgacccgagttcccagaatcagtcctgaccgcccttcccccaccacaggtgaacttcgtctcaggggagcttgcttgttctttttgcagaagctcagaataaacgctcaactttggccgccacccctgtgtcaaaaggggaggaattgatcaaagagaaccctcatcctaaactgtaccctgagggaactgtcaacaatcaccacttcaaatgcacctcagagggcgagggaaagccctacgaagggacccagacccctcgcattaaggtggtcgaaggcggaccactcccttttgcattcgacatcctggctacctccttcccttacggatcgcgcacttttatcaagtacccgaaggggatcccggacttcttcaagcaatccttccctgagggattcacttgggaacgggtcacgacctacgaagatggaggcgtggtgaccgtgcctcaagacactagcctggaagatggctgccttgtctacaacgtgaagatcagaggtgtgaacttcccatccaatggccccgtgcctcagaaaaagactctggggtgggaagccaataccgaacctctctacccagcggacggaggactcgaaggccggtctgaccctgccctgaagctggtcggaggaggacatttgtcgtgtagctttgtgactacgtaccggtcgaagaagccggccaaaaacctgaagatgccgggtatccacgcggtggaccatagactggaacgcctggaggagagcgataacgagatgttcgtcgttcagagggaacacgctgtggcacgatattgcgatctcccgtcgaagcttggtcacaagctcaattaatgaaaaatctgatcttctgaagaaaatatatttctttttattcatagctcttaactagtggtgatagcaatgtcagcagtgcctttgagttacaatgagacagctggtgaagccacagatgcagctgtctccttgtaactcacaagtaaggttgaccatactctactctagagttgtgttttaatgtatattaatgttactaatgtgtttactagtggtgatagcaatgtcagcagtgccttattctgaccaataaaagcaaggtgaagccacagatgcttgcttttactggtcagaatcaagtaaggttgaccatactctactctaggttatttttagtatgattctgtaaaaatgaattaatactaactagtggtgatagcaatgtcagcagtgcctttttacctgaagaactagcagcgtgaagccacagatggctgctagttattcaggtaaacaagtaaggttgaccatactctactctagtcagttttattgatagtcttttcagtattattgataatcttggggaaaagctggagcctcggtagccgttcctcctgcccgctgggcctcccaacgggccctcctcccctccttgcaccggcccttcctggtctttgaataaatggctaataaaggaaatttattttcattgcaatagtgtgttggaattttttgtgtctctcactcggaaggacatatgggagggcaaatcatttaaaacatcagaatgagtatttggtttagagtttggcaacatatgcccatatgctggctgccatgaacaaaggttggctataaagaggtcatcagtatatgaaacagccccctgctgtccattccttattccatagaaaagccttgacttgaggttagattttttttatattttgttttgtgttatttttttctttaacatccctaaaattttccttacatgttttactagccagatttttcctcctctcctgactactcccagtcatagctgtccctcttctcttatggagatcacctgctcagtcagaaaatctagagcgagctcacggggacagcccccccccaaagcccccagggatgtaattacgtccctcccccgctagggggcagcagcgagccgcccggggctccgctccggtccggcgctccccccgcatccccgagccggcagcgtgcggggacagcccgggcacggggaaggtggcacgggatcgctttcctctgaacgcttctcgctgctctttgagcctgcagacacctggggggatacggggaaaaagctttaggctgaaagagagatttagaatgacagaatcatagaacggcctgggttgcaaaggagcacagtgctcatccagatccaaccccctgctatgtgcagggtcatcaaccagcagcccaggctgcccagagccacatccagcctggccttgaatgcctgcagggatggggcatccacagcctccttgggcaacctgttcagtgcgtcaccaccctctgggggaaaaactgcctcctcatatccaacccaaacctcccctgtctcagtgtaaagccattcccccttgtcctatcaagggggagtttgctgtgacattgttggtctggggtgacacatgtttgccaattcagtgcatcacggagaggcagatcttggggataaggaagtgcaggacagcatggacgtgggacatgctggtgttgagggctctgggacactctccaagtcacagcgttcagaacagccttaaggataagaagataggatagaaggacaaagagcaagttaaaacccagcatggagaggagcacaaaaaggccacagacactgctggtccctgtgtctgagcctgcatgtttgatggtgtctggatgcaagcagaaggggtggaagtgcttgcctggagagatacagctgggtcagtaggactgggacaggcagctggagaattgccatgtagatgttcatacaatcgtcaaatcatgaaggctggaaaagccctccaagatccccaagaccaaccccaacccacccaccgtgcccactggccatgtccctcagtgccacatccccacagttcttcatcacctccagggacggtgacccccccacctccgtgggcagctgtgccactgcagcaccgctctttggagaaggtaaatcttgctaaatccagcccgaccctcccctggcacaacgtaaggccattatctctcatccaactccaggacggagtcagtgagaatattcctagctttgatcaaaaactgaaaataataaaaaaaaactcaactaaaggaacgaaagacaaccgatacagtaaatcataaaaaaagaacaatggataacataaaaataccaataaaacagttgaaattaataatcggaaaaattacataaaaaaaatacgtcaacaatgaggcagggtataacatacccgaaacaggtttgcacacgaatatctcgccggtgtcccgtgccacactgcgatcacgccactatcccctcccgcacgctcctgcctccagctactgagcgcgctagtgttgtcagacgaaaattttataaaatacacaactttaaaattttaccagggtatgagataccctgcctcatgctcgccgggttaa

SEQ ID NO: 1188 - DNA, 466 bp, Artificial sequence; identical to SEQ ID NO: 968
  Synthetic

SEQ ID NO: 1189 - DNA, 2329 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtccgccaccatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1190 - DNA, 2326 bp, Artificial sequence
  Synthetic
cactgacgggcaccggagcctcacgaagtttgaattgcggcgacagatcaagtttcctctggagacaatgacggtaaatggcccgcctggcattatgcccagtacatgaccttacgggactttcctacttggcagtacatctacgtattagtcatcgctattaccatgctgatgcggttttggcagtacaccaatgggcgtggatagcggtttgactcacggggatttccaagtctccaccccattgacgtcaatgggagtttgttttggcaccaaaatcaacgggactttccaaaatgtcgtaataaccccgccccgttgacgcaaatgggcggtaggcgtgtacggtgggaggtctatataagcagagctcgtttagtgaaccgtcagatcgcctggagaggccatccacgctgttttgacctccatagtggacaccgggaccgatccagcctccgcgccaccatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1191 - DNA, 2273 bp, Artificial sequence
  Synthetic
gggtccgaatttcaaagtcctttttattgacttacaaggttttcaaggaaaatcttggaagtaactgtgttccgaagaatctacgtttaaaaaccgacccctggatctttgccttgggtccaaggaccgagctggccacgccccagccgcgccgcagccactcccaaggcagttcaagtgttaagcccgaaaggtagagctctgcgcatgtgcacacccgtccatagctgggtcccagccaaccaggccggaggagcacccgcgccgtcacgtgacgtgcccaaccggcgtcgacctataaaaggccgggcgttgacgtcagcggactcttccgccgcagccgccgccatcgtcggcgcgcttccctgttcacctctgtatttgagaatccgacgccatctgccacgccaccatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1192 - DNA, 2051 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtccgccaccatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagagttgtgttttaatgtatattaatgttactaatgtgttttcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1193 - DNA, 2211 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtccgccaccatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgttttcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1194 - DNA, 2516 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1195 - DNA, 2514 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggattttttatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1196 - DNA, 2270 bp, Artificial sequence
  Synthetic
cagctgcttcatccccgtggcccgttgctcgcgtttgctggcggtgtccccggaagaaatatatttgcatgtctttagttctatgatgacacaaaccccgcccagcgtcttgtcattggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggacacttcacatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1197 - DNA, 2153 bp, Artificial sequence
  Synthetic
ttggcgaaaacacgcagatgcagtcggggcggcgcggtcccaggtccacttcgcatattaaggtgacgcgtgtggcctcgaacacagagcgactctgcagggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggattttttatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactaatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

SEQ ID NO: 1198 - DNA, 2577 bp, Artificial sequence
  Synthetic
tctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgactcactagtctcgtgcagatggacagcaccgctgagcaatggaagcgggtaggcctttggggcagcggccaatagcagctttgctccttcgctttctgggctcaggggcggggcgggcgcccgaaggtcctccggaggcccggcattctgcacgcttcaaaagcgcacgtctgccgcgctgttctcctcttcctcatctccgggcctttcgtcggacacaagacaggcttgcgccaccatggttgagaataccactttatcccgcgtcagggagaggcagtgcgtaaaaagacgcggaaccatgtgaaatactggtttttagtgcgccagatctctataatctcgcgcaacctattttcccctcgaacactttttaagccgtagataaacaggctgggattttttatggccacctcagcaagttcccacttgaacaaaaacatcaagcaaatgtacctgtgcctgccccagggtgagaaagtccaagccatgtatatctgggttgatggtactggagaaggactgcgctgcaaaacccgcaccctggactgtgagcccaagtgtgtagaagagttacctgagtggaattttgatggctctagtacctttcagtctgagggctccaacagtgacatgtatctcagccctgttgccatgtttcgggaccccttccgccgggagcccaacaagctggtgttctgtgaagttttcaagtacaaccggaagcctgcagagacaaatttaaggcactcctgtaaacggataatggacatggtgagcaaccagcacccctggtttggaatggaacaggagtatactctgatgggaacagatgggcacccttttggttggccttccaatggctttcctgggccccaaggtccgtattactgtggtgtgggcgcagacaaagcctatggcagggatatcgtggaggctcactaccgcgcctgcttgtatgctggggtcaagattacaggaacaaatgctgaggtcatgcctgcccagtgggagttccaaataggaccctgtgaaggaatccacatgggagatcatctctgggtggcccgtttcatcttgcatcgagtatgtgaggactttggggtaatagcaacctttgaccccaagcccattcctgggaactggaatggtgcaggctgccataccaactttagcaccaaggccatgcgggaggagaatggtctgaagcacatcgaggaggccatcgagaaactaagcaagcggcaccagtaccacattcgagcctacgatcccaaggggggcctggacaatgcccgtcgtctgactgggttccacgaaacgtccaacatcaacgacttttctgctggtgtcgccaatcgcagtgccagcatccgcattccccggactgtcggccaggagaagaaaggttactttgaagatcgccgcccctctgccaattgtgacccctttgcagtgacagaagccatcgtccgcacatgccttctcaatgagactggcgacgagcccttccaatacaaaaactggatccgctcagacatgataagatacattgatgagtttggacaaaccacaactagaatgcagtgatgatgaatctgatcttctgaagaaaatatatttctttttattcatagctcttaactagtggtgatagcaatgtcagcagtgcctggaaaaacatccattctcattcgtgaagccacagatggaatgagaatagatgtttttcaaagtaaggttgaccatactctactctagttatattctttaggcacgaatgtgtgtttaaaaaaaataaaaactagtggtgatagcaatgtcagcagtgcctttaaattacataatgtggcagtgtgaagccacagatgactgccacatcatgtaatttacaagtaaggttgaccatactctactctagagttgtgttttaatgtatattaatgttactaatgtgtttactagtggtgatagcaatgtcagcagtgccttattttactgtgcatgggcttggtgaagccacagatgcaagcccatgaacagtaaaatcaagtaaggttgaccatactctactctagtcagttttattgatagtcttttcagtattattgataatcttctcgctttcttgctgtccaatttctattaaaggttcctttgttccctaagtccaactactaaactgggggatattatgaagggccttgagcatctggattctgcctaataaaaaacatttattttcattgcaatgatgtatttaaattatttctgaatattttactaaaaagggaatgtgggaggtcagtgcatttaaaacataaagaaa

What is claimed is:

1. A polynucleotide comprising
   a) a segment encoding a multi-hairpin amiRNA sequence, wherein the segment comprises
      i) a first guide strand sequence comprising a contiguous 19 nucleotide sequence that is perfectly complementary to a first target site in a natural mammalian cellular mRNA of SEQ ID NO: 21 and a first passenger strand sequence comprising a contiguous 19 nucleotide sequence that is at least 78% complementary to the first guide strand sequence, wherein the first guide strand and first passenger strand sequence are separated by between 5 and 35 nucleotides;
      ii) a second guide strand sequence comprising a contiguous 19 nucleotide sequence that is perfectly complementary to a second target site different than the first target site in the same natural mammalian cellular mRNA as the first guide strand sequence and a second passenger strand sequence comprising a contiguous 19 nucleotide sequence that is at least 78% complementary to the second guide strand sequence, wherein the second guide strand and second passenger strand sequences are separated by between 5 and 35 nucleotides, and wherein the first and second guide strand sequences are different from each other; and
   b) a eukaryotic promoter that is active in a mammalian cell and is transcribed by RNA polymerase II or RNA polymerase III operably linked to the segment encoding the amiRNA sequence, wherein the amiRNA sequence can be expressed and fold into multiple hairpins;
   wherein the first and second guide strand sequences are selected from SEQ ID NOs: 114-129.

2. The polynucleotide of claim 1, wherein the first guide strand sequence is a 19-22 nucleotide sequence perfectly complementary to the natural mammalian cellular mRNA and the first passenger strand sequence has the same length as the first guide sequence.

3. The polynucleotide of claim 1, wherein the first guide strand sequence is a 19-22 nucleotide sequence perfectly complementary to the natural mammalian cellular mRNA and the first passenger strand sequence is shorter than the first guide sequence.

4. The polynucleotide of claim 1, wherein the first and second target sites do not overlap.

5. The polynucleotide of claim 1, wherein the segment encoding the multi-hairpin amiRNA sequence further comprises a third guide strand sequence comprising a contiguous 19 nucleotide sequence that is perfectly complementary to the same natural mammalian cellular mRNA as the first and second guide strand sequences and a third passenger strand sequence comprising a contiguous 19 nucleotide sequence that is at least 78% complementary to the third guide strand sequence, wherein the third guide strand and third passenger strand sequences are separated by between 5 and 35 nucleotides, and wherein the first, second and third guide strand sequences are different from each other.

6. The polynucleotide of claim 1, further comprising two transposon ends flanking the segment and the promoter, wherein the segment and the promoter are transposable by a corresponding transposase.

7. The polynucleotide of claim 6, wherein each transposon end comprises a sequence selected from SEQ ID NOs: 1004 and 1005, or from SEQ ID NOs: 1010 and 1011, or from SEQ ID NOs: 1014 and 1015, or from SEQ ID NOs: 1016 and 1017, or from SEQ ID NOs: 1022 and 1023, or from SEQ ID NOs: 1026 and 1027, or from SEQ ID NOs: 1030 and 1031, or from SEQ ID NOs: 1036 and 1037, or from SEQ ID NOs: 1040 and 1041, or from SEQ ID NOs: 1044 and 1045, or from SEQ ID NOs: 1112 and 1113.

8. The polynucleotide of claim 1, wherein the polynucleotide comprises SEQ ID NO: 741.

9. A mammalian cell comprising the polynucleotide of claim 1 integrated into its genome.

10. The mammalian cell of claim 9, wherein the multi-hairpin amiRNA sequence is expressed and inhibits expression of the natural cellular mRNA, whereby the cell requires exogenous provision of glutamine in order to grow.

11. A mammalian cell comprising (a) the polynucleotide of claim 1 integrated into its genome, wherein the multi-hairpin amiRNA sequence is expressed and inhibits expression of the natural cellular mRNA and (b) a second polynucleotide comprising a gene encoding glutamine synthetase expressible in the mammalian cell, wherein expression of the gene compensates for the inhibition of the expression of the natural cellular mRNA, whereby the cell grows without the exogenous provision of glutamine.

12. The mammalian cell of claim 11, wherein the second polynucleotide further comprises a second gene expressible in the mammalian cell.

13. A method of selecting for integration of a nucleic acid encoding a target protein into the genome of a cell comprising;
  a) culturing a population of mammalian cells according to claim 10 in the presence of glutamine required by the cell to grow due to inhibition of expression of the natural cellular mRNA by the multi-hairpin amiRNA sequence;
  b) transfecting the population of cells with a second polynucleotide comprising a gene encoding a glutamine synthetase expressible in the mammalian cells and a second gene encoding the target protein, wherein expression of the glutamine synthetase compensates for the inhibition of the expression of the natural cellular mRNA thereby restoring capacity to grow without glutamine;
  c) culturing the transfected cells with a reduced concentration or absence of the glutamine,
  wherein transfected cells surviving culturing have integrated the second polynucleotide into their genomes and can thereby express the target protein.

14. The method of claim 13, wherein the transfected cells are cultured with a downward tapering of the glutamine.

15. A polynucleotide comprising
  a) a segment encoding a multi-hairpin amiRNA sequence, wherein the segment comprises
    i) a first guide strand sequence comprising a contiguous 19 nucleotide sequence that is perfectly complementary to a first target site in a natural mammalian cellular mRNA of SEQ ID NO: 23 and a first passenger strand sequence comprising a contiguous 19 nucleotide sequence that is at least 78% complementary to the first guide strand sequence, wherein the first guide strand and first passenger strand sequence are separated by between 5 and 35 nucleotides;
    ii) a second guide strand sequence comprising a contiguous 19 nucleotide sequence that is perfectly complementary to a second target site different than the first target site in the same natural mammalian cellular mRNA as the first guide strand sequence and a second passenger strand sequence comprising a contiguous 19 nucleotide sequence that is at least 78% complementary to the second guide strand sequence, wherein the second guide strand and second passenger strand sequences are separated by between 5 and 35 nucleotides, and wherein the first and second guide strand sequences are different from each other; and
  b) a eukaryotic promoter that is active in a mammalian cell and is transcribed by RNA polymerase II or RNA polymerase III operably linked to the segment encoding the amiRNA sequence, wherein the amiRNA sequence can be expressed and fold into multiple hairpins;
  wherein the first and second guide strand sequences are selected from SEQ ID NOS:130-142.

16. The polynucleotide of claim 15, wherein the segment encoding the multi-hairpin amiRNA sequence further comprises a third guide strand sequence comprising a contiguous 19 nucleotide sequence that is perfectly complementary to the same natural mammalian cellular mRNA as the first and second guide strand sequences and a third passenger strand sequence comprising a contiguous 19 nucleotide sequence that is at least 78% complementary to the third guide strand sequence, wherein the third guide strand and third passenger strand sequences are separated by between 5 and 35 nucleotides, and wherein the first, second and third guide strand sequences are different from each other.

17. The polynucleotide of claim 15, further comprising two transposon ends flanking the segment and the promoter, wherein the segment and the promoter are transposable by a corresponding transposase.

18. The polynucleotide of claim 17, wherein each transposon end comprises a sequence selected from SEQ ID NOs: 1004 and 1005, or from SEQ ID NOs: 1010 and 1011, or from SEQ ID NOs: 1014 and 1015, or from SEQ ID NOs: 1016 and 1017, or from SEQ ID NOs: 1022 and 1023, or from SEQ ID NOs: 1026 and 1027, or from SEQ ID NOs: 1030 and 1031, or from SEQ ID NOs: 1036 and 1037, or from SEQ ID NOs: 1040 and 1041, or from SEQ ID NOs: 1044 and 1045, or from SEQ ID NOs: 1112 and 1113.

19. A mammalian cell comprising the polynucleotide of claim 15 integrated into its genome.

20. The mammalian cell of claim 19, wherein the multi-hairpin amiRNA sequence is expressed and inhibits expression of the natural cellular mRNA, whereby the cell requires exogenous provision of glutamine in order to grow.

21. A mammalian cell comprising (a) the polynucleotide of claim 15 integrated into its genome, wherein the multi-hairpin amiRNA sequence is expressed and inhibits expression of the natural cellular mRNA, and The b) a second polynucleotide comprising a gene encoding a glutamine synthetase expressible in the mammalian cell, wherein expression of the gene compensates for the inhibition of the expression of the natural cellular mRNA, whereby the cell grows without exogenous provision of glutamine.

22. The mammalian cell of claim 21, wherein the second polynucleotide further comprises a second gene expressible in the mammalian cell.

23. A method of selecting for integration of a nucleic acid encoding a target protein into the genome of a cell comprising;
  a) culturing a population of mammalian cells according to claim 19 in the presence of an enzyme, growth factor, nutrient or other molecule required by the cell to grow due to inhibition of expression of the natural cellular mRNA by the multi-hairpin amiRNA sequence;
  b) transfecting the population of cells with a second polynucleotide comprising a gene encoding a selectable marker expressible in the mammalian cells and a second gene encoding the target protein, wherein expression of the selectable marker gene compensates for the inhibition of the expression of the natural cellular mRNA thereby restoring capacity to grow without the enzyme, growth factor, nutrient or other molecule;
  c) culturing the transfected cells with a reduced concentration or absence of the enzyme, growth factor, nutrient or other molecule,
  wherein transfected cells surviving culturing have integrated the second polynucleotide into their genomes and can thereby express the target protein.

24. The method of claim 23, wherein the transfected cells are cultured with a downward tapering of the enzyme, growth factor, nutrient or other molecule.

* * * * *

UNITED STATES PATENT AND TRADEMARK OFFICE
CERTIFICATE OF CORRECTION

PATENT NO. : 11,162,102 B2
APPLICATION NO. : 16/872051
DATED : November 2, 2021
INVENTOR(S) : Minshull et al.

It is certified that error appears in the above-identified patent and that said Letters Patent is hereby corrected as shown below:

In the Claims

Column 138, Claim 21, Line 30, delete "The b)" and insert --(b)--

Signed and Sealed this
Ninth Day of August, 2022

Katherine Kelly Vidal
*Director of the United States Patent and Trademark Office*